United States Patent
Tomashek et al.

(10) Patent No.: US 11,268,079 B2
(45) Date of Patent: Mar. 8, 2022

(54) COMPOSITIONS OF BETA-GLUCURONIDASE ENZYME BLENDS WITH ENHANCED ENZYMATIC ACTIVITY AND METHODS OF PREPARATION THEREOF

(71) Applicant: INTEGRATED MICRO-CHROMATOGRAPHY SYSTEMS, INC., Irmo, SC (US)

(72) Inventors: John Tomashek, Columbia, SC (US); Caleb Reece Schlachter, Irmo, SC (US); Pongkwan Sitasuwan, Columbia, SC (US); Lim Andrew Lee, Columbia, SC (US)

(73) Assignee: INTEGRATED MICRO-CHROMATOGRAPHY SYSTEMS, INC., Irmo, SC (US)

( * ) Notice: Subject to any disclaimer, the term of this patent is extended or adjusted under 35 U.S.C. 154(b) by 0 days.

(21) Appl. No.: 16/528,292

(22) Filed: Jul. 31, 2019

(65) Prior Publication Data
US 2020/0040319 A1  Feb. 6, 2020

Related U.S. Application Data

(60) Provisional application No. 62/754,358, filed on Nov. 1, 2018, provisional application No. 62/713,188, filed on Aug. 1, 2018.

(51) Int. Cl.
| | |
|---|---|
| *C12N 9/24* | (2006.01) |
| *C12Q 1/37* | (2006.01) |
| *C12Q 1/00* | (2006.01) |

(52) U.S. Cl.
CPC ........... *C12N 9/2405* (2013.01); *C12Q 1/005* (2013.01); *C12Q 1/37* (2013.01); *C12Y 301/06001* (2013.01); *C12Y 302/01031* (2013.01)

(58) Field of Classification Search
None
See application file for complete search history.

(56) References Cited

U.S. PATENT DOCUMENTS

| | | | |
|---|---|---|---|
| 4,994,390 | A | 2/1991 | Wiatr |
| 5,071,765 | A | 12/1991 | Wiatr |
| 6,391,547 | B1 | 5/2002 | Jefferson et al. |
| 6,641,996 | B1 | 11/2003 | Jefferson et al. |
| 6,664,097 | B2 | 12/2003 | Russell et al. |
| 7,087,420 | B1 | 8/2006 | Jefferson et al. |
| 7,141,719 | B2 | 11/2006 | Jefferson et al. |
| 7,148,407 | B2 | 12/2006 | Wenzl |
| 7,176,006 | B2 | 2/2007 | Jefferson et al. |
| 8,491,891 | B2 | 7/2013 | Roffler et al. |
| 9,719,075 | B2 | 8/2017 | Lee |
| 9,909,111 | B2 | 3/2018 | Yang et al. |
| 9,920,306 | B2 | 3/2018 | Lee |
| 2003/0003562 | A1 | 1/2003 | Russell et al. |
| 2003/0157684 | A1 | 8/2003 | Jefferson et al. |
| 2004/0091922 | A1 | 5/2004 | Russell et al. |
| 2005/0153448 | A1 | 7/2005 | Wenzl |
| 2005/0227306 | A1 | 10/2005 | Fox et al. |
| 2007/0037246 | A1 | 2/2007 | Butt et al. |
| 2007/0081986 | A1 | 4/2007 | Tomatsu et al. |
| 2009/0041741 | A1 | 2/2009 | Sly et al. |
| 2010/0129367 | A1 | 5/2010 | Roffler et al. |
| 2011/0237506 | A1* | 9/2011 | Garigapati .............. A61P 19/02 514/8.8 |
| 2013/0011381 | A1 | 1/2013 | Sly et al. |
| 2015/0086526 | A1* | 3/2015 | Xie ...................... A61K 38/465 424/94.6 |
| 2016/0090582 | A1 | 3/2016 | Lee |
| 2016/0237415 | A1 | 8/2016 | Lee |
| 2017/0267985 | A1 | 9/2017 | Yang et al. |
| 2018/0067116 | A1 | 3/2018 | Rozas Andreu et al. |
| 2020/0002458 | A1 | 1/2020 | Kajita |
| 2020/0024586 | A1 | 1/2020 | Lee et al. |
| 2020/0109386 | A1 | 4/2020 | Schlachter et al. |

FOREIGN PATENT DOCUMENTS

| | | |
|---|---|---|
| EP | 1175495 B1 | 10/2006 |
| WO | 00/55333 A1 | 9/2000 |
| WO | 2010/138522 A2 | 12/2010 |
| WO | 2015/016124 A1 | 2/2015 |

(Continued)

OTHER PUBLICATIONS

Chica et al. Curr Opin Biotechnol. Aug. 2005;16(4):378-84. (Year: 2005).*
Singh et al. Curr Protein Pept Sci. 2017, 18, 1-11 (Year: 2017).*
Accession K0JGG2. Nov. 28, 2012 (Year: 2012).*
Accession C4Z6Z2. Jul. 28, 2009 (Year: 2009).*
Zhang et al. Enzyme Microb Technol. Feb. 2018; 109:20-24. Epub Sep. 19, 2017. (Year: 2017).*

(Continued)

*Primary Examiner* — Christian L Fronda
(74) *Attorney, Agent, or Firm* — Nelson Mullins Riley & Scarborough LLP; Jill Gorny Sloper, Esq.

(57) ABSTRACT

Blends of enzymes of the same enzyme class (same EC number), such as beta-glucuronidase enzyme blends, are provided that exhibit synergistic levels of activity across a range of substrates as compared to the activity levels of each enzyme in the blend individually. The blends also may exhibit a greater effective substrate range, as well as greater effective pH and/or temperature ranges as compared to single enzyme preparations. Predictive methods for determining optimal enzyme blends, methods for preparing enzyme blends, enzyme blend compositions, enzyme blend formulations and methods of using such enzyme blends are provided.

8 Claims, 18 Drawing Sheets

Specification includes a Sequence Listing.

(56) References Cited

FOREIGN PATENT DOCUMENTS

| WO | WO-2016100871 A1 * | 6/2016 | ..... C12Y 302/01003 |
|----|--------------------|--------|----------------------|
| WO | 2018/136082 A1     | 7/2018 |                      |

OTHER PUBLICATIONS

Sakurama, H. et al., "Beta-Glucuronidase from Lactobacillus brevis useful for baicalin hydrolysis belongs to glycoside hydrolase family 30," Appl Microbiol Biotechnol., vol. 98:4021-4032 (2014).
Sanchez, P. et al., "Fetal exposure to arsenic results in hyperglycemia, hypercholesterolemia, and nonalcoholic fatty liver disease in adult mice," J. Anal. Toxicol., vol. 36:162 (2014).
Sitasuwan, P. et al., "Degradation of Opioids and Opiates During Acid Hydrolysis Leads to Reduced Recovery Compared to Enzymatic Hydrolysis," J. Anal. Toxicol., vol. 40:601 (2016).
Stahl, P. et al., "Beta-Glucuronidase of Rat Liver Lysosomes," J. Biol. Chem., vol. 246:5398 (1971).
Steffens, DL et al., "Efficient Site-Directed Saturation Mutagenesis Using Degenerate Oligonucleotides," J. Biomol. Tech., vol. 18:147-149 (2007).
Sudan, C. et al., "Ubiquitous presence of beta-glucuronidase (GUS) in plants and its regulation in some model plants," Planta, vol. 224:853 (2006).
Ulrich, A. et al., "Exponential megapriming PCR (EMP) cloning—seamless DNA insertion into any target plasmid without sequence constraints," PLoS ONE, vol. 7:e53360 (2012).
Wallace, B. et al., "Alleviating Cancer Drug Toxicity by Inhibiting a Bacterial Enzyme," Science, vol. 330:831 (2010).
Wallace, B. et al., "Structure and Inhibition of Microbiome beta-Glucuronidases Essential to the Alleviation of Cancer Drug Toxicity," Chem. Biol., vol. 22(9):1238-1249 (2015).
Wang et al., "Incomplete Recovery of Prescription Opioids in Urine using Enzymatic Hydrolysis of Glucuronide Metabolites," J. Anal. Toxicol., vol. 30:570 (2006).
Wang, C. et al., "Studies of Catalysis by beta-Glucuronidase," J. Biol. Chem., vol. 247:2644 (1972).
Waterhouse, A. et al., "SWISS-MODEL: homology modelling of protein structures and complexes," Nucleic Acids Res., vol. 46(W1):W296-W303 (2018).
Wierenga, R.K. et al., "The TIM barrel fold: a versatile framework for efficient enzymes," FEBS Letters, vol. 492:193-198 (2001).
Xiong, A.S. et al., "Directed evolution of a beta-galactosidase from Pyrococcus woesei resulting in increased thermostable beta-glucuronidase activity," Appl Microbiol Biotechnoly, vol. 77(3), pp. 569-578 (2007).
Xiong, A., et al. "Concurrent mutations in six amino acids in beta-glucuronidase improve its thermostability," Protein Engineering, Design & Selection, vol. 20(7) pp. 319-325 (2007).
Yang, HS et al., "Development and Validation of a Novel LC-MS/MS Opioid Confirmation Assay: Evaluation of beta-glucuronidase Enzymes and Sample Cleanup Methods," J. Anal. Toxicol., vol. 40:323 (2016).
Yeom, S.J. et al., "Controlled Aggregation and Increased Stability of beta-Glucuronidase by Cellulose Binding Domain Fusion.," PLoS ONE, vol. 12:e0170398 (2017).
U.S. Appl. No. 15/076,134, filed Mar. 21, 2016, Lim Andrew Lee.
U.S. Appl. No. 14/867,710, filed Sep. 28, 2015, Lim Andrew Lee.
U.S. Appl. No. 15/076,183, filed Mar. 21, 2016, Jia Yang.
U.S. Appl. No. 16/478,674, filed Jul. 17, 2019, Lim Andrew Lee.
U.S. Appl. No. 16/596,568, filed Oct. 8, 2019 Caleb Reece Schlachter.
U.S. Appl. No. 15/076,134, Apr. 3, 2017.
U.S. Appl. No. 15/076,134, Dec. 2, 2016.
U.S. Appl. No. 15/076,134, Jul. 27, 2016.
U.S. Appl. No. 14/867,710, Oct. 30, 2017.
U.S. Appl. No. 14/867,710, Aug. 16, 2017.
U.S. Appl. No. 14/867,710, Jan. 12, 2017.
U.S. Appl. No. 14/867,710, Jul. 27, 2016.
U.S. Appl. No. 15/076,183, Oct. 24, 2017.
U.S. Appl. No. 15/076,183, Jun. 7, 2017.
U.S. Appl. No. 15/076,183, Mar. 24, 2017.
Aich S. et al., "Expression and Purification of Escherichia coli beta-Glucuronidase," Protein Expression and Purification, vol. 22 (1), pp. 75-81, (2001).
Benkert et al., "Toward the estimation of the absolute quality of individual protein structure models," Bioinformatics, vol. 27:343-350 (2011).
Bertoni, M. et al., "Modeling protein quaternary structure of homo- and hetero-oligomers beyond binary interactions by homology," Sci. Reports, vol. 7: 10480: 15 pages (2017).
Bienert, S. et al., "The SWISS-MODEL Repository—new features and functionality," Nucleic Acid Res. vol. 45:D313-D319 (2017).
Burchett, G. et al., "Native Electrophoresis-Coupled Activity Assays Reveal Catalytically-Active Protein Aggregates of Escherichia coli beta-Glucuronidase," PLoS ONE, vol. 10(6): e0130269 (2015).
Callanan, M.J. et al. , "Modification of Lactobacillus beta-glucuronidase activity by random mutagenesis," Gene, vol. 389, pp. 122-127 (2007).
Chen, C. et al., "ECSTASY, an adjustable membrane-tethered/soluble protein expression system for the directed evolution of mammalian proteins," Protein Engineering, Design & Selection, vol. 25(7), pp. 367-375 (2012).
Chen, G. J. et al., "Restriction Site-Free Insertion of PCR Products Directionally into Vectors," BioTechniques, vol. 28:498-500 (2000).
Chronopoulou, E. et al., "Site saturation Mutagenesis: A Powerful Tool for Structure Based Design of Combinatorial Mutation Libraries," Curr. Protocols Protein Sci., vol. 63:26.6.1-26.6.10 (2011).
Cummings, O. et al., "Impact of beta-Glucuronidase Mediated Hydrolysis on Haldol® Urinalysis," J. Anal. Toxicol., vol. 42:214 (2018).
Davies, G. et al., "Structures and mechanisms of glycosyl hydrolases," Structure, vol. 3:853 (1995).
Feng, X. et al., "Enhancing the Thermostability of beta-Glucuronidase by Rationally Redesigning the Catalytic Domain Based on Sequence Alignment Strategy," Ind. Eng. Chem. Res., vol. 55:5474-5483 (2016).
Flores, H. et al., "Increasing the thermal stability of an oligomeric protein, beta-glucuronidase.," J. Mol. Biol., vol. 315, Issue 3, pp. 325-337 (2002).
Folz. R-J. et al., "Substrate specificity of eukaryotic signal peptidase. Site-saturation mutagenesis at position-1 regulates cleavage between multiple sites in human pre (delta pro) apolipoprotein A-II.," J. Biol. Chem., vol. 263:2070-2078 (1988).
Fukao, M. et al., "Genomic Analysis by Deep Sequencing of the Probiotic Lactobacillus brevis KB290 Harboring Nine Plasmids Reveals Genomic Stability," PLoS ONE 8(3): e60521. doi:10.1371/journal.pone.0060521 (2013).
Geddie, M. et al., "Rapid Evolution of beta-Glucuronidase Specificity by Saturation Mutagenesis of an Active Site Loop," The Journal of Biological Chemistry, vol. 279(25) pp. 26462-26468 (2004).
GenBank Accession No. WP 015255760.1, published May 28, 2013.
Genseq Accession No. AAW93825, published Jun. 15, 2007.
Graef, V. et al., "Hydrolysis of steroid glucuronides with beta-glucuronidase preparations from bovine liver, Helix pomatia, and E. coli.," Clin. Chem., vol. 23:532 (1977).
Guex, N. et al., "Automated comparative protein structure modeling with SWISS MODEL and SwissPdbViewer: A historical perspective," Electrophoresis, vol. 30:S162-S173 (2009).
Hassan, I. et al., "High resolution crystal structure of human beta-glucuronidase reveals structural basis of lysosome targeting," PLoS ONE 8:e79687 (2013).
Hernandez et al., "Control of protein immobilization: Coupling immobilization and site-directed mutagenesis to improve biocatalyst or biosensor performance," Enzyme and Microbial Technology, vol. 48:107-122 (2011).
Hochuli, E. et al., "Genetic Approach to Facilitate Purification of Recombinant Proteins with a Novel Metal Chelate Adsorbent," Nature Biotech., vol. 6:1321-1325 (1988).
International Preliminary Report on Patentability, PCT/US2017/014387, dated Jul. 23, 2019, 6 pages.
International Search Report and Written Opinion, PCT/US2017/014387, dated Apr. 19, 2017, 10 pages.

(56) References Cited

OTHER PUBLICATIONS

Jain, S. et al., "Structure of human beta-glucuronidase reveals candidate lysosomal targeting and active-site motifs," Nature Struct. Biol., vol. 3:375 (1996).

Joshi, M. et al., "Dissecting the Electrostatic Interactions and pH-Dependent Activity of a Family 11 Glycosidase†,‡," Biochemistry 40:10115 (2001).

Kim H.S. et al., "Cloning and expression of beta-glucuronidase from Lactobacillus brevis in *E. coli* and application in the bioconversion of baicalin and wogonoside," J Microbiol Biotechnol., vol. 19(12), pp. 1650-1655 (2009).

Kotronoulas, A. et al., "Evaluation of two glucuronides resistant to enzymatic hydrolysis as markers of testosterone oral administration," J. Steroid Biochem. Mol. Biol., vol. 167B:212 (2017).

Kuiper, H.A., et al., "Illegal use of beta-adrenergic agonists: European Community," J. Animal Sci., vol. 76:195-207 (1998).

Lin, Z. et al., "Evaluation of Analytical Procedures for Urinary Codeine and Morphine Measurements," J. Anal. Toxicol. 18:129-133 (1994).

Lv, B. et al., "Structure-guided engineering of the substrate specificity of a fungal beta-glucuronidase toward triterpenoid saponins," J. Biol. Chem., vol. 293(2):433-443 (2018).

Masuo, Y. et al., "Characterization of Inhibitory Effect of Carbapenem Antibiotics on the Deconjugation of Valproic Acid Glucuronide," Drug Metab. Disp., vol. 38:1828 (2010).

Matsumura, I. et al., "Directed evolution of the surface chemistry of the reporter enzyme beta-glucuronidase," Nat. Biotechnol., vol. 17(7):696-701 (1999).

Matsumura, I., et al., "In vitro evolution of beta-glucuronidase into a beta-galactosidase proceeds through non-specific intermediates," J. Mol. Biol. vol. 305(2), pp. 331-339 (2001).

Mcintosh, L. et al., "The pKa of the General Acid/Base Carboxyl Group of a Glycosidase Cycles during Catalysis:beta-A 13C-NMR Study of Bacillus circulans Xylanase†," Biochemistry, vol. 35:9958 (1996).

Morris, A. et al., "Opioid Hydrolysis by a Novel Recombinant Beta-Glucuronidase for Urinalysis," Ameritox Medication Monitoring Solutions, Poster Presentation, 2014, Society of Forensic Toxicologists Annual Meeting, held in Grand Rapids, Michigan, Oct. 19-24, 2014, 1 page.

Morris, A.A. et al., "Rapid Enzymatic Hydrolysis Using a Novel Recombinant beta-Glucuronidase in Benzodiazepine Urinalysis," Journal of Analytical Toxicology, vol. 38, pp. 610-614 (2014).

Morris, A.A. et al., "Rapid Enzyme Hydrolysis Using a Novel Recombinant beta-Glucuronidase in Benzodiazepine Urinalysis," Ameritox Medication Monitoring Solutions, Poster Presentation, 2014, American Association of Clinical Chemistry Annual Meeting in Chicago, Illinois, Jul. 30, 2014, 1 page.

Morris, A.A. et al., Buprenorphine Hydrolysis Using a Novel Recombinant Beta-glucuronidase for Urine Drug Testing, Ameritox Medication Monitoring Solutions, Poster Presentation, 2014, Society of Forensic Toxicologists Annual Meeting, held in Grand Rapids, Michigan, Oct. 19-24, 2014, 1 page.

Nakamura, T. et al., "Possible Evidence of Contamination by Catechins in Deconjugation Enzymes from Helix pomatia and Abalone entrails," Biosci. Biotechnol. Biochem., vol. 75:1506 (2011).

Ngo et al. "The Protein Folding Problem and Tertiary Structure Prediction," Merz et al. (ed.), Birkhauser, Boston, MA, pp. 433 and 492-495 (19940.

Pellock, S. et al., "Gut Microbial beta-Glucuronidase Inhibition via Catalytic Cycle Interception," ACS Central Science, vol. 4: 868-879 (2018).

PIR Accession No. A25047, published Jun. 30, 1988.

PIR Accession No. A72300, published Jun. 11, 1999.

Pollet, R. et al., "An Atlas of beta-Glucuronidases in the Human Intestinal Microbiome," Structure, vol. 25:967 (2017).

Rana, S. et al., "A New Method for Simultaneous Determination of Cyclic Antidepressants and their Metabolites in Urine Using Enzymatic Hydrolysis and Fast GC-MS," J. Anal. Toxicol., vol. 32:355 (2008).

Roberts, A. et al., "Molecular Insights into Microbial beta-Glucuronidase Inhibition to Abrogate CPT-11 Toxicity," Mol. Pharmacol. 84:208 (2013).

Romberg, R.W. et al., "Comparison of the Hydrolysis Rates of Morphine-3-Glucuronide and Morphine-6-Glucuronide with Acid and beta-Glucuronidase," J. Anal. Toxicol., vol. 19:157 (1995).

Russell W.M., et al., "Identification and cloning of gusA, Encoding a New Beta-Glucuronidase from Lactobacillus Gasser ADH," Applied and Environmental Microbiology, vol. 67(3): 1253-1261 (2001).

Devos et al.,Proteins: Structure, Function and Genetics, 2000, vol. 41: 98-107.

Whisstock et al., Quarterly Reviews of Biophysics 2003, vol. 36 (3): 307-340.

Witkowski et al., Biochemistry 38:11643-11650, 1999.

Kisselev L., Structure, 2002, vol. 10: 8-9.

U.S. Appl. No. 16/596,568, Nov. 24, 2020.

U.S. Appl. No. 16/596,568, Apr. 19, 2021.

* cited by examiner

```
EeGUS    ------------------------------MLYPVLTQSRL-LSDLSGVWDFKLDNG--------       26
AoGUS    ------------------------------MLKPQQTTTRD-LISLDGLWKFALAS--------       25
Rxn3     ------------------------------MLKPQQTTTRD-LISLDGLWKFALAS--------       25
AtGUS    ------------------------------MLKPRQTPFRD-LISLDGLWKFALDSG-------       26
EcE1F    ------------------------------MLRPVETPTRE-IKKLDGLWAFSLDREN------       27
BpGUS    ----------------------------MVNSMLYPRESRTRR-VVDISGMWEFKIDIN-----       30
BmGUS    ----------------------------MVNSMLYPRESRTRR-VVDISGMWEFKIDSN-----       30
CpGUS    ------------------------------MLYPIITESRQ-LIDLSGIWKFKLNEG-------       26
StpGUS   ------------------------------MLYPINTETRG-VFDLNGVWNFKLDYG-------       26
LbLR2D   ------------------------------MLYPMETASRV-VLDLSGVWRFMIDKE-------       26
SaGUS    ------------------------------MLYPLLTKTRN-TYDLGGIWNFKLG---------       24
HsGUS    MARGSAVAWAALGPLLWGCALGLQGGMLYPQESPSRE-CKELDGLWSFRADFSDN----      54
BfGUS    -MKKLLAAAMLFMLNSWSCFSADTPRAEYPRPQFEREQWVNLNGTWTFDFDFGK-----      53
PmGUS    -MKRISIAFLSLFLCVASVWSMPRP--EYPRPQFERAGWVNLNGEWTCSFDFGG------      51
BuGUS    ---MKTLLKNSLTFLLMLMPVLAFAQQAPQIMNVSARQTTSLDGQWKTIVDPFENGYYDY      57
                                       .:.* *

EeGUS    ------------KGFEEKWYEKPLKD----ADTMPVPASYNDLKEGTDFRDHYGWVFYQRNI       72
AoGUS    ------------DDNNTQPWTSQLKT----SLECPVPASYNDIFADSKIHDHVGWVYYQRDV       71
Rxn3     ------------DDNNTQPWTSQLKT----SLECPVPASYNDIFADSKIHDHVGWVYYQRDV       71
AtGUS    ------------DNATAAPWTGPLTT----DLECPVPASYNDIFVDRQIRDHVGWVYYQREA       72
EcE1F    ------------CGIDQRWWESALQE----SRAIAVPGSFNDQFADADIRNYAGNVWYQREV       73
BpGUS    ------------NEGRNSGYANGLKD----TTFIPVPSSFNDLFTDKNIREHAGDVWYETSF       76
BmGUS    ------------NEGRKNGYANGLKD----TTFIPVPSSFNDLFTDKNIREHAGDIWYETSF       76
CpGUS    ------------NGLTEELSKAPLED----TIEMAVPSSYNDLVESQEVRDHVGWWYERNF       72
StpGUS   ------------KGLEEKWYESKLTD----TISMAVPSSYNDIGVTKEIRNHIGYVWYEREF       72
LbLR2D   ------------Q--IPVDVTRPLPA----TLSMAVPASFNDQTASKEIREHVGYVWYERCF       70
SaGUS    ---------------EHNPNELLPS----DEVMVIPTSFNDLMVSKEKRDYIGDFWYEKVI       66
HsGUS    ---------RRRGFEEQWYRRPLWESGPTVDMPVPSSFNDISQDWRLRHFVGWWYEREV      105
BfGUS    ------------SGKDRRLQSAEKFD----KNITVPFCPESKLSGVGYTDFIEQMWYQRNI       98
PmGUS    ------------SGMEREFYKSKGFD----KKITVPFCPESKLSGIGYTDFINHFWYQRPI       96
BuGUS    RLKPYDGGYAQDKTYSDKTKLQEYDFETDKLLFVPGDWN--TQRPQLYYYEGTVWYRKHF      115
                     :*    :       .    .:*.

EeGUS    SVPEYVKS---QRIVLRCAAVTHYAMIYLNGKLICEHKGGFLPFEVELNDDLQDGD----      125
AoGUS    IVPKGWSE---ERYLVRCEAATHHGRIYVNGNLVADHVGGYTPFEADITDLVAAGEQ---      125
Rxn3     IVPKGWSE---ERYLVRCEAATHHGRIYVNGNLVADHVGGYTPFEADITDLVAAGEQ---      125
AtGUS    IVPRAWSQ---QQYLVRVDAATHQGRIYINDNLVAEHRGGYTPFEADITGLVSAGDS---      126
EcE1F    FIPKGWAG---QRIVLRFDAVTHYGKVWVNNQEVMEHQGGYTPFEADVTPYVIAGKS---      127
BpGUS    YLPLEWKD---KDVNRFGCATHEATVYINGKEVCTHVGGFMPFNAPVNEAGIFGEK---      130
BmGUS    YLPLEWKD---KNVNIRFGCATHEAAVYINGKEVCTHVGGFMPFNAPVNEAGIFGEK---      130
CpGUS    TIPKTLLN---ERIVLRFGSATHEAKVYLNGELLVEHKGGFTPFEAEINDLLVSGD----      125
StpGUS   TVPAYLKD---QRIVLRFGSATHKAIVYVNGELVVEHKGGFLPFEAEINNSLRDGM----      125
LbLR2D   ELPQLLRQ---ERLVLRFGSATHEAWVYLNGHLITHHKGGFTPFEVEINDDLVTGE----      123
SaGUS    EVPKVSEG---EEMVLRFGSVTHQAKIYVDGILVGEHKGGFTPFEVLVPECKYNNEK---      120
HsGUS    ILPERWTQDLRTRVVLRIGSAHSYAIWVNGVDTLEHEGGYLPFEADISNLVQVGPLPSR      165
BfGUS    TIPSDWNG---KKIFLNFGAVDYCAEIYVDGKFVQRHFGGSSSFAVDLTRYVTPGKT---      152
PmGUS    TIPQEWNG---KNILLNFGAVYYKSEVYIDGVLASRHFGGTSSFAVDITSLVKPGQT---      150
BuGUS    EYSLQPGK----RLFLNFGAVNYEAIVWLNGKRLGRHIGGFTPFNFEITNLLKEGTN---      168
                  :.  ..  . ::::.    * **  .*    :        .
```

FIG. 1A

```
EeGUS    NLLTIAVNNVIDYTTLPVGGKANMMSGMMGGMGAGASDKPQNNPNFDFFNYCGITRPVKI    185
AoGUS    FRLTIAVDNELTYQTIPPGK----------VEILEATGKKVQTYQHDFYNYAGLARSVWL    175
Rxn3     FRLTIAVDNELTYQTIPPGK----------VEILEATGKKVQTYQHDFYNYAGLARSVWL    175
AtGUS    FRLTIAVNNELTHETIPPGR----------IEVEEYTGKRVQVYQHDFFNYAGLARSVWL    176
EcE1F    VRITVCVNNELNWQTIPPG-----------MVITDENGKKKQSYFHDFFNYAGIHRSVML    176
BpGUS    NKLVVVVNNELSNTTIPCG-----------HTETKPSGKKYIKPSFDFFNYAGLNRPVKI    179
BmGUS    NKLVVVVNNELSNTTLPCG-----------HTETKPSGKKYIKPSFDFFNYAGLNRPVKI    179
CpGUS    NRLTVAVNNIIDETTLPVG--------LVKEVEVDGK-KVIKNSVNFDFFNYAGIHRPVKI    177
StpGUS   NRVTVAVDNILDDSTLPVG--------LYSERHEEGLGKVIRNKPNFDFFNYAGLHRPVKI    178
LbLR2D   NRLTVKLSNMLDYTTLPVG--------HYKETQNETGQRVRQLDENFDFFNYAGLQRPVKI    176
SaGUS    IKVSICANNVLDYTTLPVG--------NYSEIIQEDGSIKKKVRENFDFFNYAGVHRPLKL    173
HsGUS    LRITIAINNTLTPTTLPPGT-----IQYLTDTSKYPKGYFVQNTYFDFFNYAGLQRSVLL    220
BfGUS    HNLVVFVQDDLRSGLQTGGK---------------QCGNYYSGGCSYTRTTGIWQTVWM    196
PmGUS    HSLVVYVESDVRGAKQAAGK---------------QNLQYASYGCNYTRTTGIWQTVWM    194
BuGUS    -SLVVKVDNKRLPEAVPTVN---------------------------ADWWNFGGITRPVTL    202
               :  ..    .                    .:  .  *: :.: :

EeGUS    YTTPETYINDITVTADIDFTKEEPSAVLNYNVEIKGKDYNNITCKVELFDEEGTKLSETE    245
AoGUS    YSVPQQHIQDITVRTDVQG------TTGLIDYNVVAS-TTQGTIQVAVIDEDGTTVATSS    228
Rxn3     YSVPQQHIQDITVRTDVQG------TTGLIDYNVVAS-TTQGTIQVAVIDEDGTTVATSS    228
AtGUS    YSVPQQHIQDIKVVTHVKG------SAGLINYLVTVSNSTTGRVKIDVIDKDGTTVAEAS    230
EcE1F    YTTPNTWVDDITVVTHVQD----CNHASVDWQVVAN----GDVSVELRDADQQVVATGQ    228
BpGUS    TVTNKEYIHDIDILSDVNGS----DGIVNYEVHTTGENK----VYIKINDEEGKEVASCE    231
BmGUS    TVTNKEYIYDIDILSDINGS----DGIVNYEVHTTGENK----VFVKIYDEEGKEAASAE    231
CpGUS    YTTPKSYIEDITIVTDFKEN----NGYVNYEVQAVGKCN----IKVTIIDEENNIVAEGE    229
StpGUS   YTTPFTYVEDISVVTDFNGP----TGTVTYTVDFQGKAET---VKVSVVDEEGKVVASTE    231
LbLR2D   YSTPHSYIRDITLTPKVNLT--NHSAVVNGEIETVGDVEQ---VVVTILDEDNQVVGTTS    231
SaGUS    MIRPKNHISDITITSRLSDD--LQSADLHFLVETNQKVDE---VRISVFDEDNKLVGETK    228
HsGUS    YTTPTTYIDDITVTTSVEQD-------SGLVNYQISVKGSNLFKLEVRLLDAENKVVANGT    274
BfGUS    EAVSADGLKSVFVRPDIDQK----QLVIEPEFYNESANTLEITLKDRNKTVAKKSVNCAN    252
PmGUS    EAVHPEGLQSIQLLTDIDQQ----QLVVRPRFYKEAGGKLQVTLKDNGKVVASRTVSASS    250
BuGUS    IEMPATYIRDYYVQLAKDDK----NMIEGWVQLEGSDKEQKITLDIPELKVKKEVTTDAN    258
              :  .  :

EeGUS    GSEGTFEISNVRLWQP-----LNAYLYKIKVTAG---------QDVYTLPYGVRSVRVDGT    292
AoGUS    GSNGTIHIPSVHLWQP-----GAAYLYQLHASIIDS--SKKTIDTYKLATGIRTVKVQGT    281
Rxn3     GSNGTIHIPSVHLWQP-----GAAYLYQLHASIIDS--SKKTIDTYKLATGIRTVKVQGT    281
AtGUS    GARGSVTIDSVKLWQP-----GEAYLYQFRASIVGL--NDSVVDTYCVETGVRTVKVSGN    283
EcE1F    GTSGTLQVVNPHLWQP-----GEGYLYELCVTAKS----QTECDIYPLRVGIRSVAVKGE    279
BpGUS    GKSGKIVIKDAKLWNP-----KAAYLYKFIACIKN---GDELIDEYYLDFGIRTVKVEGT    283
BmGUS    GKNGKIVIKNAKLWNP-----KAAYLYKFEACIKN---GEELIDEYYLDFGIRTIKVEGT    283
CpGUS    GKEGKLTINNVHLWEP-----MNAYLYKLKVELLD---DEEIIDTYFEEFGVRTVEVKDG    281
StpGUS   GLSGNVEIPNVILWEP-----LNTYLYQIKVELVN---DGLTIDVYEEPFGVRTVEVNDG    283
LbLR2D   GKTLAIELNSVHLWQP-----GKAYLYRAKVELYQ---AGQVIDTYIETFGIRQIAVKAG    283
SaGUS    --DSRLFLSDVHLWEV-----LNAYLYTARVEIFV---DNQLQDVYEENFGLREIEVTNG    278
HsGUS    GTQGQLKVPGVSLWWPYLMHERPAYLYSLEVQLTAQTSLGPVSDFYTLPVGIRTVAVTKS    334
BfGUS    SSVVVLPVKNMKLWSP-----EDPFLYDLVYQVKDA--KGNVLDEVKSYAGMRKVHTANG    305
PmGUS    LSSVVLPVKKMKTWSP-----ESPFLYDLEYKVLDK--NGNIIDEVNGYAGMRKVHIEGN    303
BuGUS    GYASFLIKSKPILWTP-----ENPKLYAVNLASET--------DKVSDEIGFRTIRTEGI    305
                  *      **              *      *.* :
```

FIG. 1B

```
EeGUS    KFLINEKPFYFKGYGKH-EDTFPNGRGINLPMNTKDISIMKWQHANSFRTSHYPYSEEMM  351
AoGUS    QFLINDKPFYFTGFGKH-EDTNIRGKGHDDAYMVHDFQLLHWMGANSFRTSHYPYAEEVM  454
Rxn3     QFLINDKPFYFTGFGKH-EDSAVRGKGYDPAYMVHDFQLMDWMGANSFRTSHYPYAEEVM  340
AtGUS    RFLINDKPFYFTGFGKH-EDSAVRGKGYDPAYMVHDFQLMDWMGANSFRTSHYPYAEEVM  342
EcE1F    QFLINHKPFYFTGFGRH-EDADLRGKGFDNVLMVHDHALMDWIGANSYRTSHYPYAEEML  338
BpGUS    KFLINGKPFYFTGFGKH-EDSEIAGRGYNPPVIKRDFELIKWVGANSFRTSHYPYSEEIM  342
BmGUS    KFLINGKPFYFTGFGKH-EDSETAGRGYNPPVIKRDFELIKWIGANSFRTSHYPYSEEIM  342
CpGUS    KFLINNKPFYFKGFGKH-EDSYVNGRGINEAINIKDFNLMKWIGANSFRTSHYPYSEEIM  340
StpGUS   KFLINNKPFYFKGFGKH-EDTPINGRGFNEASNVMDFNILKWIGANSFRTAHYPYSEELM  342
LbLR2D   KFLINGQPFYFKGFGKH-EDAYIHGRGLSEPQNVLDLSLMKQMGANSFRTSHYPYSEEMM  342
SaGUS    QFLLNRKPIYFKGFGKH-EDTFINGRGLNEAANLMDLNLLKDIGANSFRTSHYPYSEEMM  337
HsGUS    QFLINGKPFYFHGVNKH-EDADIRGKGFDWPLLVKDFNLLRWLGANAFRTSHYPYAEEVM  393
BfGUS    RFYLNNQPYFQRLVLDQGFYPEGIWTAPSDEDLKNDIVLGKEAGFNGARLHQKVFEERYY  365
PmGUS    KIYLNNKPYYQRLVLDQGFYPDGIWTAPSDEALKRDIELSMEAGFNGARLHQKVFEERFY  363
BuGUS    KILLNDKEIFCRGISIHEETPYYSGRAYSKDHAHTLLSWAKELGCNFVRLAHYPHNEEMV  365
         ::.:*  :.          :           :      .  .    *   *  :. .*.

EeGUS    RLCDEEGIVVIDETTAVGVNLQFGGGANFGGERIGTFDKEHG-VQTQEHHKDVIRDLISR  410
AoGUS    EYADRQGIVVIDETPAVGLAFSIGAGAQTSNPP-ATFSPDRINNKTREAHAQAIRELIHR  399
Rxn3     EFADRHGIVVIDETPAVGLAFSIGSGVSSEDSP-QTFTPEGINNNTREAHKQAIRELIAR  399
AtGUS    EFADRHGIVVIDETPAVGLAFSIGSGVSSEDSP-QTFTPEGINNNTREAHKQAIRELIAR  401
EcE1F    DWADEHGIVVIDETAAVGFNLSLGIGFEAGNKPKELYSEEAVNGETQQAHLQAIKELIAR  398
BpGUS    QAADREGIVIIDEVAAVGMFDVGSVLNPSASKTDYFSLDEVH-SKTKEVHKKAVEELIKR  401
BmGUS    QAADREGIVIIDEIAAVGMFDVGSVLNPGASKADYFSLEEVH-TKTKEIHKKAVEELITR  401
CpGUS    RLADREGIVVIDETPAVGLHLNFMATG-FGGDAP-KRDTWKE-IGTKEAHERILRELVSR  397
StpGUS   RLADREGLVVIDETPAVGVHLNFMATTGLGEGSE-RVSTWEK-IRTFEHHQDVLRELVSR  400
LbLR2D   RLCDREGIVVIDEVPAVGLMLSFTFDVSALEKDDFEDDTWEK-LRTAEAHRQAITEMIDR  401
SaGUS    RLADRMGVLVIDEVPAVGLFQNFNASLDLSPKD---NGTWSL-MQTKAAHEQAIQELVKR  393
HsGUS    QMCDRYGIVVIDECPGVGLALPQFFNN------------------VSLHHHMQVMEEVVRR  436
BfGUS    YWADKLGYITWGESASWMLDVNK---------------------ELAARNFLGEWSEVVVR  405
PmGUS    YWADKMGYLTWGEASSWGMDCND---------------------TETARNFITEWSEIVQR  403
BuGUS    REAERMGFLVWSEIPVYWTIHWEN---------------------KDTYQNAEQQLCDMIAR  406
         .:.. *  : .*                    :              :::  *

EeGUS    DKNHACVVMWSIANEPDSAAEGAYDYFKPLYDLARELDPQKRPCTLVS----VQGTTADT  466
AoGUS    DKNHPSVVMWSIANEPASNEDGAREYFAPLPKLARQLDPT-RPVTFAN----VGLATYKA  454
Rxn3     DKNHASVVMWSIANEPASQEVGAREYFAPLVDLAHELDPS-RPVCFAN----YGDATYEV  454
AtGUS    DKNHASVVMWSIANEPASQEVGAREYFAPLVDLAHELDPS-RPVCFAN----YGDATYEV  456
EcE1F    DKNHPSVVMWSIANEPDTRPQGAREYFAPLAEATRKLDPT-RPITCVN----VMFCDAHT  453
BpGUS    DKNHPSVVMWSLFNEPDTSKDEAVPYFEDIFNFAKSQDKQNLPKTFAA----IQASSPGK  457
BmGUS    DKNHPSVVMWSLFNEPDTSKDEALPYFEDIFNFAKSIDKQNLPKTFAA----IQASAPGK  457
CpGUS    DKNHPCVVMWSVANEPDSDSEGAKEYFEPLIKLTKELDPQKRPVTVVT----YLMSTPDR  453
StpGUS   DKNHPSVVMWSIANEAATEEEGAYEYFKPLVELTKELDPQKRPVTIVL----FVMATPET  456
LbLR2D   DKNHASVVMWSISNEAANFSKGAYEYFKPLFDLARKLDPQQRPCTYTS----IMMTTLKT  457
SaGUS    DKNHPSVVMWVVANEPASHEAGAHDYFEPLVKLYKDLDPQKRPVTLVN----ILMATPDR  449
HsGUS    DKNHPAVVMWSVANEPASHLESAGYYLKMVIAHTKSLDPS-RPVTFVS----NSN--YAA  489
BfGUS    DRNHPSLVTWTPFNETWGGGPDAYIRLVRDVYNITKAIDPTRPVNDASGD--NHVITDIW  463
PmGUS    DRNHPSLLIWTPTNEEFWPDRVQYPRLMHDLYNLTKMIDPTRPFHGASGG--THIATDIW  461
BuGUS    DKNRCNIIIWSIANETP-HSETRLTFLSNLANKARSLDSVRLIGAAMEKEEVQPGVLTVN  465
         *:*:  ::  *   **                                    :::  *
```

FIG. 1C

```
EeGUS    DCSSQLSDVICLNRYYG----------WYFGGPDLEVSEIGLR-KELSDWGKLG--KPVM  513
AoGUS    DRIADLFDVLCLNRYFG----------WYTQTAELDEAEAALE-EELRGWTEKYD-KPIV  502
Rxn3     DRISDMFDVLCLNRYFG----------WYSQTGEVEEAEAALE-KELLGWEGKYG-KPIV  502
AtGUS    DRISDMFDVLCLNRYFG----------WYSQTGEVEEAEAALE-KELLGWEGKYG-KPIV  504
EcE1F    DTISDLFDVLCLNRYYG----------WYVQSGDLETAEKVLE-KELLAWQEKLH-QPII  501
BpGUS    CKCMHLCDVITLNRYYG----------WYFLGG-YEIDMSEEK-FREEMNLYSNMNKPVM  505
BmGUS    CKCMHLCDVITLNRYYG----------WYFLGG-YEIDMSEEK-FREEMNLYKDMNKPVM  505
CpGUS    CKVGDIVDVLCLNRYYG----------WYVAGGDLEEAKRMLE-DELKGWEERCPKTPIM  502
StpGUS   DKVAELIDVIALNRYNG----------WYFDGGDLEAAKVHLR-QEFHAWNKRCPGKPIM  505
LbLR2D   DRCLALADVIALNRYYG----------WYMGNGDLKAAETATR-EELLAYQAKFPDKPIM  506
SaGUS    DQVMDLVDVVCLNRYYG----------WYVDHGDLTNAEVGLR-KELLEWQDKFPDKPII  498
HsGUS    DKGAPYVDVICLNSYYS----------WYHDYGHLELIQLQLA-TQFENWYKKYQ-KPII  537
BfGUS    SVHNYEQDRAKLTEQLK-------------------MEEGKEPYRNARDKDFLAVYEGQPYM  506
PmGUS    TVHNYEQDPAKLKEKLYNGGKLMEAPKWEIHLMPMNIGYNGLKYTDQYAFPEYKKDMPYL  521
BuGUS    DPLGELLDIISFNEYVG----------WYDGDSEKCDR----------VNWTFDTQKPVF  505
                  *         :.                                    *  .

EeGUS    FTEYGADTVSGLHDTTSVMYTEEYQVEYYEMNNKVFD--EFDFVVGEQAWNFADFATSQ-  570
AoGUS    MTEYGADTVAGLHSVMVTPWSEEFQVEMLDMYHRVFD--RFEAMAGEQVWNFADFQTAV-  559
Rxn3     ITEYGADTMAGLHSVLALPWSEEFQVQLLDMYHRVFD--RIDSVVGEHVWNFADFQTAV-  559
AtGUS    ITEYGADTMAGLHSVLALPWSEEFQVQLLDMYHRVFD--RIDSVVGEHVWNFADFQTAV-  561
EcE1F    ITEYGVDTLAGLHSMYTDMWSEEYQCAWLDMYHRVFD--RVSAVVGEQVWNFADFATSQ-  558
BpGUS    FTEYGADTYAGVHKLPSVMWSEEYQCEYYEMNFKVFD--SYDFIVGEQLWNFADFQTTE-  562
BmGUS    FTEYGADTYAGVHKLPSVMWSEEYQCEYYEMNFKVFD--SYDFIIGEQLWNFADFQTTE-  562
CpGUS    FTEYGADTVAGLHDTVPVMFTEEYQVEYYKANHEVMD--KCKNFVGEQVWNFADFATSQ-  559
StpGUS   ITEYGADTVAGFHDIDPVMFTEEYQVEYYQANHVVFD--EFENFVGEQAWNFADFATSQ-  562
LbLR2D   YTEYGADTIAGLHSNYDEPFSEEFQEDYYRMCSRVFD--EVTNFVGEQLWNFADFQTKF-  563
SaGUS    ITEYGADTLPGLHSTWNIPYTEEFQCDFYEMSHRVFD--GIPNLVGEQVWNFADFETNL-  555
HsGUS    QSEYGAETIAGFHQDPPLMFTEEYQKSLLEQYHLGLDQKRRKYVVGELIWNFADFMTEQ-  596
BfGUS    VDEFGGIPWMAEK----DRKNSWGYGGMPENAEAFYKRLEGQIDAFIDSP-HVTGFCYT-  560
PmGUS    VDEFGGIKWNPSQQMESAQNTSWGYGEPPRSLEEFYARLEGQVDAVLSLSNDIWGYCYT-  580
BuGUS    ISELGGGALYGRHGSPKERFTEEYQEDLYIRHVNMLK--RIPGLAGTTPWILKDFRSPRR  563
          * *         :         ..

EeGUS    --SLLRVQGNKKGLFTRDRKPKMVAHYFRNRWSTIPEFGYKTK--------------   611
AoGUS    --GVSRVDGNKKGVFTRDRKPKAAAHLLRKWTNLHNGTAEGSKTFQ----------   604
Rxn3     --GIIRVDGNKKGVFTRERKPKAAAHTLKTRWSGMLGSDH----------------   597
AtGUS    --GIIRVDGNKKGVFTRERKPKAAAHTLKTRWSGMLGSDH----------------   599
EcE1F    --SILRVGGNKKGIFTRDRKPKSAAFLLQKRWTGMNFGEKPQQGSKQGLCGR-----   608
BpGUS    --GIFRVDGNKKGIFTRNRQPKAVAHLIRSRWNKLPLDYKSKK-------------   603
BmGUS    --GIFRVDGNKKGIFTRTRQPKAVAHYIRSRWTKLPLDYKK---------------   601
CpGUS    --GIIRVQGNKKGIFTRERKPKMIAHSLRERWTNIPEFGYKK-------------   599
StpGUS   --GVMRVQGNKKGVFTRDRKPKLAAHVFRERWTNIPDFGYKN-------------   602
LbLR2D   --GIQRVQGNKKGIFTRAREPKMVVRYLTQRWRNIPDFNYKK-------------   603
SaGUS    ---MILRVQGNHKGLFSRNRQPKQVVKEFKKRWMTIPHYHNKKNSVK--------   599
HsGUS    --SPTRVLGNKKGIFTRQRQPKSAAFLLRERYWKIANETRYPHSVAKSQCLENSLFT   651
BfGUS    --QLTDVEQEKNGIYYYDRTPKLDMKRIKAIFEKIK-------------------   594
PmGUS    --QLTDVEQEQNGIYYYDRTPKFDMKRIHAIFSKTPESK---------------   617
BuGUS    HVPEIQDDFNRKGLVSDKGQKKKAFFVLQKWYKELTEAYK-------------   603
          :::*:         *      *      :     :
```

FIG. 1D

COMPOSITIONS OF BETA-GLUCURONIDASE ENZYME BLENDS WITH ENHANCED ENZYMATIC ACTIVITY AND METHODS OF PREPARATION THEREOF

RELATED APPLICATIONS

This application claims priority to U.S. Provisional Application No. 62/713,188 (filed Aug. 1, 2018) and U.S. Provisional Application No. 62/754,358 (filed Nov. 1, 2018), each of which are incorporated herein by reference in their entireties.

SEQUENCE LISTING

The instant application contains a Sequence Listing which has been submitted electronically in ASCII format and is hereby incorporated by reference in its entirety. Said ASCII copy, created on Jul. 29, 2019, is named IMJ-009_SL.txt and is 635,585 bytes in size.

BACKGROUND OF THE INVENTION

In mammals, glucuronidation via the UDP glucuronyl transferase system is one of the principle means of detoxifying or inactivating compounds. Compounds are conjugated by the glucuronyl transferase system to form glucuronides, which are then secreted in urine or into the lower intestine in bile. The beta-glucuronidase (BGUS) enzyme catalyzes the hydrolysis of a wide variety of beta-glucuronides. Given the key role of glucuronidation in detoxification of compounds, the BGUS enzyme has been used for detection of drugs in bodily samples, such as to detect the presence of therapeutic drugs in bodily samples of hospital patients. For example, a bodily sample can be tested for the presence of a drug by treating the sample with BGUS and detecting the hydrolysis product of the glucuronide form of the drug. The hydrolysis of the glucuronide by the BGUS enzyme facilitates the analysis of the drug by methods such as mass spectrometry, since this analytical instrument is less sensitive to the glucuronide.

Beta-glucuronidases (BGUS; EC 3.2.1.31) hydrolyze the beta-glycosidic bond between the anomeric reducing end of glucuronic acid (GlcU or gluc) and a broad range of possible aglycones. Enzymes with this activity are found predominantly in glycosyl hydrolase family 2 (GH2), although other examples can also be found in GH30 (Sakurama et al. (2014), *Appl. Microbiol. Biotechnol.* 98: 4021), GH1, GH79 and GH137. All BGUS enzymes characterized thus far are retaining enzymes, utilizing a double displacement reaction with a covalent enzyme-glucuronic acid intermediate to add water across the glycosidic bond (Wang and Trouser (1972) *J. Biol. Chem.* 247:2644; Davies and Henrissat (1995) *Structure* 3:853). Well characterized examples come from bacteria, particularly *E. coli* gusA (formerly uidA), mammalian species (bovine, mouse, rat, human), where the enzyme normally localizes to lysosomes and defects may contribute to lysosomal storage disorders, and mollusks (snail, abalone, limpet), the source of crude hydrolytic extracts utilized for both research and applications in forensic and clinical medicine (Graef et al. (1977) *Clin. Chem.* 23:532; Romberg and Lee (1995) *J. Anal. Toxicol.* 19:157; Yang et al. (2016) *J. Anal. Toxicol.* 40:323). Additional applications for the preparation of food additives and traditional remedies are under consideration (Kim et al. (2009) *J. Microbiol. Biotechnol.* 19:1650; Sakurama et al. (2014) *Appl. Microbiol. Biotechnol.* 98:4021).

Genes for BGUS, especially gusA, have been favored as reporters in gene regulation studies because of the wide range of substrates with easily detected aglycone products (non-limiting example of aglycones include p-nitrophenol, phenolphthalein, 4-methylumbelliferone, indigo-blue, fluorescein). This is particularly true for studies in plants, where for many years BGUS activity was believed to be absent. Evidence of naturally occurring BGUS in plants has been discovered, but plant enzymes generally have lower pH optima and growth-specific expression patterns (Sudan et al. (2006) *Planta* 224:853).

Structures for GH2 BGUS enzymes have been solved from multiple sources, both with and without ligands in the active site (Jain et al. (1996) *Nature Struct. Biol.* 3:375; Wallace et al. (2010) *Science* 330:831; Roberts et al. (2013) *Mol. Pharmacol.* 84:208; Hassan et al. (2013) *PLoS ONE* 8:e79687; Wallace et al. (2015) *Chem. Biol.* 22:1238; Pollet et al. (2017) *Structure* 25:967). The approximately 70 kD enzyme monomer (approximately 600 amino acids) has three domains: an N-terminal beta-sandwich described as a sugar-binding domain (approximately 180 amino acids); a second beta-sandwich described as an immunoglobulin-like domain (approximately 110 amino acids); and an alpha/beta eight-strand TIM barrel (approximately 310 amino acids) containing the active site. The monomers form dimers with the individual active sites directly opposite each other. The dimers form tetramers, which are thought to be the active form (Stahl and Touster (1971) *J. Biol. Chem.* 246:5398; see also Yeom et al. (2017) *PLoS ONE* 12:e0170398). Additionally, higher order complexes have been observed, although their physiological relevance, if any, is unknown.

As discussed above, one significant application for BGUS enzymes is in clinical and forensic analysis of biological samples for the quantitative measurement of drugs and metabolites. In the body, toxic metabolites and foreign molecules such as drugs are glucuronidated by enzymes in the liver to increase their solubility and tag them for excretion. Thus, a broad range of glucuronidated molecules end up in the urine and other bodily fluids. To identify and quantify these molecules ("target substrates"), the preferred approach is to remove excretion tags such as glucuronic acids (some molecules are sulfated as well) and quantify the free aglycones by separation methods such as liquid chromatography (LC) and gas chromatography (GC), and methods for detection, identification and quantitation such as mass spectrometry (MS). Protocols for de-glucuronidation of excretion products initially favored acid hydrolysis (Romberg and Lee (1995) *J. Anal. Toxicol.* 19:157; Wang et al. (2006) *J. Anal. Toxicol.* 30:570). However, though simple and broadly applicable, acid hydrolysis is slow, messy and harsh, suffering from side reactions that break down some molecules targeted for analysis (Romberg and Lee (1995) *J. Anal. Toxicol.* 19:157; Sitasuwan et al. (2016) *J. Anal. Toxicol.* 40:601). In contrast, enzymatic hydrolysis is specific, potentially fast and can be accomplished under gentle conditions (Rana et al. (2008) *J. Anal. Toxicol.* 32:355; Sanches et al. (2014) *J. Anal. Toxicol.* 36:162; Morris et al. (2014) *J. Anal. Toxicol.* 38:610; Yang et al. (2016) *J. Anal. Toxicol.* 40:323; Cummings et al. (2018) *J. Anal. Toxicol.* 42:214). Thus, enzymatic methods have largely superseded acid hydrolysis.

Although the specificity of BGUS is determined by its ability to recognize glucuronic acid and the anomeric bond (Pollet et al. (2017) *Structure* 25:967), interactions between an aglycone and an enzyme are unique to the aglycone and enzyme pair in question, likely due to steric interactions that are not yet well characterized (Masuo et al. (2010) *Drug Metab. Disp.* 38:1828; Kotronoulas et al. (2017) *J. Steroid Biochem. Mol. Biol.* 167B:212). Crude enzyme preparations of BGUS from mollusks (e.g., snail, abalone, limpet) are commercially available and thus have been used for clinical and forensic analysis purposes. In some instances, however, crude enzyme preparations contain contaminants that interfere with either enzyme activity or downstream measurement of products (Nakamura et al. (2011) *Biosci. Biotechnol. Biochem.* 75:1506).

More recently, purified recombinant BGUS enzymes have been described, including variant forms of recombinant BGUS enzymes that have been modified to enhance enzymatic activity, temperature stability or both (see e.g., US Patent Publication 20160090582, issued as U.S. Pat. No. 9,920,306; US Patent Publication 20160237415, issued as U.S. Pat. No. 9,719,075; US Patent Publication 20170267985, issued as U.S. Pat. No. 9,909,111; Xiong, A-S. et al. (2007) *Prot. Eng. Design Select.* 20:319-325). For example, a genetically modified recombinant *E. coli* K12 BGUS enzyme is commercially available (IMCSzyme®; IMCS).

While crude enzyme BGUS preparations and recombinant BGUS enzymes are available and suitable for clinical and forensic applications, additional BGUS compositions, formulations and methods of making same are still needed in the art.

SUMMARY OF THE INVENTION

Because of the unique sequence and structure of each BGUS, each enzyme has a profile of activities across a range of target substrates. No homogenous single enzyme has high activity against all substrates of interest. Additionally, each enzyme's activity profile varies with respect to pH and temperature. When the enzyme is used in urine, urine specimens are highly heterogeneous and have pH ranged from 4.0 to 9.0. As a result, it is difficult to find one BGUS enzyme that serves all analytical needs under all conditions. The present disclosure addresses this unmet need by utilizing blends of highly purified preparations of BGUS enzymes from different sources to complement activities. The enzymes chosen for inclusion in an enzyme blend are chosen to cover as many different target substrates as possible and to overlap with respect to temperature and pH profiles, such that the level of activity across a range of substrates and/or across a pH range and/or across a temperature range of the enzyme blend is greater than the ranges for each enzyme alone. In particular, the enzyme blends of the disclosure have been shown experimentally to exhibit synergistic activity against a panel of substrates, not merely an additive effect (i.e., the level of activity of the blend against a panel of substrates is greater than would be theoretically expected from adding the activities of each enzyme against each substrate). Thus, the resultant enzyme blend of the disclosure is an enzyme composition of much higher utility than a single enzyme preparation.

Moreover, while initially described in the context of BGUS enzyme blends, the enzyme blending approach of the disclosure can be applied to other classes enzymes as well (i.e., to two or more enzymes having the same Enzyme Commission number), to thereby increase substrate range and activity (e.g., pH and/or temperature range conditions), as described further herein.

Accordingly, in various aspects, the disclosure pertains to predictive methods for determining optimal enzyme blends for the substrate composition of a particular intended use, methods for preparing enzyme blends, enzyme blend compositions, enzyme blend formulations and methods of using such enzyme blends.

In one aspect, the disclosure pertains to a composition comprising a blend of two or more enzymes, wherein each enzyme in the blend has the same Enzyme Commission (EC) number and wherein the level of activity of the blend for a range of substrates catalyzed by the blend is synergistically greater than the level of activity for the range of substrates catalyzed by each enzyme in the blend individually. Furthermore, in one embodiment, the effective range of substrates catalyzed by the blend is greater than the effective range of substrates catalyzed by each enzyme in the blend individually. Furthermore, in one embodiment, the effective pH range of the blend for one or more substrates is greater than the effective pH range of each enzyme in the blend individually. Furthermore, in one embodiment, the effective temperature range of the blend for one or more substrates is greater than the effective temperature range of each enzyme in the blend individually. In one embodiment, each enzyme in the blend is a beta-glucuronidase enzyme (EC number 3.2.1.31). In another embodiment, each enzyme in the blend is a sulfatase (EC number 3.1.6.1).

In another aspect, the disclosure pertains to a composition comprising a blend of two or more beta-glucuronidase enzymes (Enzyme Commission number 3.2.1.31), wherein:

(i) the level of activity of the blend for a range of substrates catalyzed by the blend is synergistically greater than the level of activity for the range of substrates catalyzed by each enzyme in the blend individually;

(ii) the effective range of substrates catalyzed by the blend is greater than the effective range of substrates catalyzed by each enzyme in the blend individually; or (iii) the effective pH range of the blend for one or more substrates is greater than the effective pH range of each enzyme in the blend individually; or (iv) the effective temperature range of the blend for one or more substrates is greater than the effective temperature range of each enzyme in the blend individually; or (v) any combination of (i)-(iv).

For enzyme blend compositions of the disclosure, each enzyme in the blend typically is purified to at least 90% homogeneity. In certain embodiments, at least one enzyme in the blend is a recombinant enzyme. In certain embodiments, the blend comprises at least two, at least three, at least four or at least five enzymes.

In certain embodiments, the blend comprises a first enzyme and a second enzyme, wherein the first enzyme comprises up to about 10% of the total protein mass and the second enzyme comprises up to about 90% of the total enzyme mass, or the first enzyme comprises up to about 20% of the total protein mass and the second enzyme comprises up to about 80% of the total enzyme mass, or the first enzyme comprises up to about 30% of the total protein mass and the second enzyme comprises up to about 70% of the total enzyme mass, or the first enzyme comprises up to about 40% of the total protein mass and the second enzyme comprises up to about 60% of the total enzyme mass, or the first enzyme comprises up to about 50% of the total protein mass and the second enzyme comprises up to about 50% of the total enzyme mass.

For BGUS enzyme blends, in one embodiment, the range of substrates catalyzed by the blend comprises glucuronidated metabolites of drugs comprising opiates, synthetic opioids, anti-depressants and benzodiazepines. In another embodiment, the range of substrates catalyzed by the blend comprises glucuronidated opiates comprising morphine-3-β-D-glucuronide, hydromorphone-3-β-D-glucuronide, oxymorphone-3-β-D-glucuronide, codeine-6-β-D-glucuronide and dihydrocodeine-6-β-D-glucuronide. In another embodiment, the range of substrates catalyzed by the blend comprises glucuronidated opioids comprising buprenorphine glucuronide, norbuprenorphine glucuronide and tapentadol glucuronide. In another embodiment, the range of substrates catalyzed by the blend comprises glucuronidated anti-depressants comprising O-desmethylvenlafaxine glucuronide and amitriptyline-N-β-D-glucuronide. In another embodiment, the range of substrates catalyzed by the blend comprises glucuronidated benzodiazepines comprising temazepam glucuronide, oxazepam glucuronide and lorazepam glucuronide.

For BGUS enzyme blends, in one embodiment, at least one enzyme in the blend comprises an amino acid sequence at least 90% identical to one of the amino acid sequences shown in SEQ ID NOs: 1-16. In another embodiment, at least one enzyme in the blend comprises an amino acid sequence at least 98% identical to one of the amino acid sequences shown in SEQ ID NOs: 1-16. In another embodiment, at least one of the enzymes in the blend comprises the amino acid sequence shown in SEQ ID NO: 9. In another embodiment, at least one enzyme in the blend is purified from a mollusk source, such as Helix, Haliotis, Cornu or Patella.

In another aspect, the disclosure pertains to a composition comprising a blend of *Brachyspira pilosicoli* beta-glucuronidase (BpGUS) and *Eubacterium eligens* beta-glucuronidase (EeGUS), wherein the level of activity of the blend for a range of substrates catalyzed by the blend is synergistically greater than the level of activity for the range of substrates catalyzed by each enzyme in the blend individually. In various embodiments, the blend comprises about 10%-30% BpGUS and about 70%-90% EeGUS, or about 15%-25% BpGUS and about 75%-85% EeGUS, or 15% BpGUS and 85% EeGUS or 25% BpGUS and 75% EeGUS. In one embodiment, the BpGUS comprises the amino acid sequence shown in SEQ ID NO: 5 (or an amino acid sequence 90%, 95%, 96%, 97%, 98% or 99% identical thereto). In one embodiment, the EeGUS comprises the amino acid sequence shown in SEQ ID NO: 10 (or an amino acid sequence 90%, 95%, 96%, 97%, 98% or 99% identical thereto). In one embodiment, the range of substrates against which the BpGUS/EeGUS blend exhibits synergistic activity comprises two or more substrates selected from morphine-3-β-D-glucuronide (M3G), oxymorphone-3-β-D-glucuronide (OM3G), hydromorphone-3-β-D-glucuronide (HM3G), codeine-6-β-D-glucuronide (C6G), dihydrocodeine-6-β-D-glucuronide (DHC6G), buprenorphine-3-β-D-glucuronide (BUP gluc), norbuprenorphine-3-β-D-glucuronide (NBUP gluc), tapentadol glucuronide (TAP gluc), O-desmethyltramadol glucuronide (ODT gluc), O-desmethylvenlafaxine glucuronide (ODV gluc), amitriptyline-N-β-D-glucuronide (AMT gluc), oxazepem glucuronide (OXZ gluc), lorazepam glucuronide (LOR gluc) and temazepam glucuronide (TEM gluc).

In another aspect, the disclosure pertains to a composition comprising a blend of *Eubacterium eligens* beta-glucuronidase (EeGUS) and a chimeric beta-glucuronidase enzyme, Rxn3, comprising the amino acid sequence shown in SEQ ID NO: 19, wherein the level of activity of the blend for a range of substrates catalyzed by the blend is synergistically greater than the level of activity for the range of substrates catalyzed by each enzyme in the blend individually. In various embodiments, the blend comprises about 70%-90% EeGUS and about 10%-30% Rxn3, or about 70%-80% EeGUS and about 20%-30% Rxn3 or 70% EeGUS and 30% Rxn3 or 80% EeGUS and 20% Rxn3. In one embodiment, the EeGUS comprises the amino acid sequence shown in SEQ ID NO: 10 (or an amino acid sequence 90%, 95%, 96%, 97%, 98% or 99% identical thereto). In one embodiment, the range of substrates against which the EeGUS/Rxn3 blend exhibits synergistic activity comprises two or more substrates selected from morphine-3-β-D-glucuronide (M3G), oxymorphone-3-β-D-glucuronide (OM3G), hydromorphone-3-β-D-glucuronide (HM3G), codeine-6-β-D-glucuronide (C6G), dihydrocodeine-6-β-D-glucuronide (DHC6G), buprenorphine-3-β-D-glucuronide (BUP gluc), norbuprenorphine-3-β-D-glucuronide (NBUP gluc), tapentadol glucuronide (TAP gluc), O-desmethyltramadol glucuronide (ODT gluc), O-desmethylvenlafaxine glucuronide (ODV gluc), amitriptyline-N-β-D-glucuronide (AMT gluc), oxazepem glucuronide (OXZ gluc), lorazepam glucuronide (LOR gluc) and temazepam glucuronide (TEM gluc).

In another aspect, the disclosure pertains to a formulation comprising an enzyme blend composition of the disclosure. In one embodiment, the formulation comprises the enzyme blend and at least one excipient, wherein each enzyme in the blend is present at a concentration of at least 0.1 mg/mL. In one embodiment, the formulation is an aqueous formulation. In another embodiment, the formulation is a lyophilized formulation. In another embodiment, the formulation is a protein pellet obtained by precipitation with an agent such as, but not limited to, ammonium sulfate. In various embodiments, at least one excipient is selected from the group consisting of water, salts, buffers, sugars and amino acids. In one embodiment, the formulation is free of polymers and detergents. Packaged formulations, comprising a formulation of the disclosure and a container, are also encompassed.

In another aspect, the disclosure pertains to a method of catalyzing a range of substrates, the method comprising contacting the range of substrates with an enzyme blend composition or formulation of the disclosure under conditions such that catalysis of the range of substrates occurs. In one embodiment, the enzyme blend is a BGUS blend and the method is a method of hydrolyzing a range of substrates comprising a glucuronide linkage, the method comprising contacting the range of substrates with a BGUS enzyme blend composition or formulation of the disclosure under conditions such that hydrolysis of the glucuronide linkage in the range of substrates occurs. In one embodiment, the range of substrates comprises opiate glucuronides. In another embodiment, the range of substrates comprises benzodiazepine glucuronides. In another embodiment, the range of substrates is in a sample of blood, urine, tissue or meconium obtained from a subject.

In yet another aspect, the disclosure pertains to a method of preparing an enzyme blend that is optimized for a given temperature, pH, and substrate target range, wherein each enzyme within the blend has the same EC number and wherein the specific activity of each enzyme on each substrate for the given temperature and pH is known, the method comprising:
(i) calculating the fractional activity of each enzyme based on the fraction of enzyme in the blend multiplied by the specific activity of the enzyme under the given conditions of temperature and pH;
(ii) summing the fractional activities for all enzymes for each substrate;
(iii) multiplying the total activities at the given temperature and pH for each substrate in the target range;

(iv) maximizing the grand total activity at the given temperature and pH by adjusting the fractions of enzyme in the blend, to thereby obtain an optimized fraction for each enzyme in the blend; and (v) combining the optimized fraction of each enzyme together to thereby prepare the enzyme blend.

In one embodiment, the enzyme blend is further optimized for a broader temperature and pH range by summing the grand totals from each temperature and pH condition and adjusting the enzyme fractions to maximize the summed grand totals. In one embodiment, the grand total activities are weighted in proportion to the probability that samples to undergo enzymatic hydrolysis will represent a particular temperature and pH condition. In one embodiment, each enzyme in the blend is a beta-glucuronidase enzyme (EC number 3.2.1.31). In another embodiment, each enzyme in the blend is a sulfatase (EC number 3.1.6.1). In another embodiment, the disclosure provides a method of preparing an enzyme blend, the method comprising combining at least two enzymes together, wherein the fraction of each enzyme in the blend has been determined according to the method of the disclosure described above.

Other features and aspects of the disclosure are described in further detail herein.

BRIEF DESCRIPTION OF THE DRAWINGS

FIGS. 1A-1D show an alignment of the amino acid sequences for the EeGUS (SEQ ID NO: 10), AoGUS (SEQ ID NO: 1), Rxn3 (SEQ ID NO: 19), AtGUS (SEQ ID NO: 2), EcE1F (SEQ ID NO: 9), BpGUS (SEQ ID NO: 5), BmGUS (SEQ ID NO: 6), CpGUS (SEQ ID NO: 7), StpGUS (SEQ ID NO: 15), LbLR2D (SEQ ID NO: 12), SaGUS (SEQ ID NO: 16), HsGUS (SEQ ID NO: 11), BfGUS (SEQ ID NO: 3), PmGUS (SEQ ID NO: 14) and BuGUS (SEQ ID NO: 4) enzymes. Amino acid residue numbering is shown on the right. Key conserved residues are indicated by (.) (:) and (*) beneath the sequences. Residues that were targeted for point mutagenesis to create certain variant enzymes described herein are indicated in black.

DETAILED DESCRIPTION OF THE INVENTION

Figure 2:
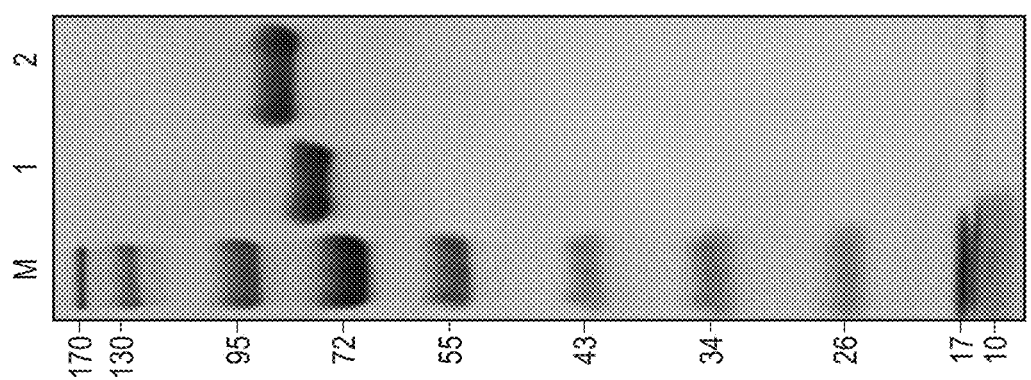
FIG. 2 is a photograph of an SDS-PAGE gel showing purification of BpGUS (Lane 1) and EeGUS (Lane 2). Molecular weight markers in kD are shown in Lane M.

A challenge facing clinical and forensic laboratories when testing for drugs and metabolites in biological samples is the fact that many of the molecules of interest are modified with glucuronic acid. The glucuronic acid can be removed with an enzyme, beta-glucuronidase, of which many examples may be found in the internationally recognized enzyme category EC 3.2.1.31. These enzymes are specific for the glucuronic acid attached to another molecule. However, beta-glucuronidases vary in activity depending upon the non-glucuronic acid part of the molecule (the aglycone), and the reason for these variances in enzyme activity towards the different substrates is largely unknown. Because clinical and forensic laboratories screen and quantify for a broad range of substrates, a single enzyme is unlikely to work efficiently across the entire drug panel of interest. Furthermore, different enzymes have different optima in terms of pH and temperature.

Accordingly, the present disclosure provides blends of enzymes and a method for optimizing that blend for maximum efficiency under defined conditions against a defined panel of substrates (e.g., glucuronidated targets). As described herein, the enzyme blends of the disclosure exhibit synergistic activity across a range of substrates that exceeds what would be expected by adding the activity of each enzyme against each substrate (i.e., the enzyme blends exhibit a synergistic effect against the substrates, not simply an additive effect).

Various aspects of the disclosure are described in further detail in the subsections below:

I. Enzyme Blends

In one aspect, the disclosure pertains to compositions comprising a blend of two or more enzymes, wherein each enzyme in the blend has the same Enzyme Commission (EC) number (i.e., all enzymes in the blend catalyze the same type of enzymatic reaction). The EC number is a numerical classification scheme for enzymes based on the chemical reactions they catalyze. As a system of enzyme nomenclature, every EC number is associated with a recommended name for the respective enzyme. An EC number specifies the enzyme-catalyzed reaction carried out by every enzyme having that same EC number. Thus, different enzymes (e.g., from different organisms) that catalyze the same reaction receive the same EC number.

Blends of different enzymes that catalyze different types of enzymatic reactions, have been described in the art (see e.g., U.S. Pat. No. 4,994,390 blending a cellulase, an alpha-amylase and a protease; U.S. Pat. No. 5,071,765, blending a beta-glucanase, an alpha-amylase and a protease). However, the instant disclosure pertains to blends of enzymes, wherein each enzyme within the blend has the same EC number and thus each enzyme in the blend catalyzes the same type of enzymatic reaction.

The enzyme blends of the disclosure have the advantage that the level of activity of the blend across a range of substrates catalyzed by the blend is greater than the additive level of activity across the range of substrates catalyzed by each enzyme in the blend individually such that the blend exhibits synergistic activity across the range of substrates. As used herein, the term "synergistic activity" with respect to an enzyme blend refers to the total activity (i.e., total level of activity) of the blend being greater than the sum of the individual activities of each enzyme in the blend against a range of substrates. For example, a blend may exhibit at least 5%, at least 10%, at least 15%, at least 20% or at least 25% greater activity against a range of substrates than the additive level of activity across the range of substrates based on each enzyme in the blend. As used herein, a "range of substrates" or "panel of substrates" refers to at least two substrates that are catalyzed by the enzyme and may include three, four, five, six, seven, eight, nine, ten, eleven, twelve, thirteen, fourteen, fifteen or more substrates.

Accordingly, in one aspect, the invention pertains to a composition comprising a blend of two or more enzymes, wherein each enzyme in the blend has the same Enzyme Commission (EC) number and wherein the level of activity of the blend for a range of substrates catalyzed by the blend is synergistically greater than the level of activity for the range of substrates catalyzed by each enzyme in the blend individually.

Furthermore, the blend may have an increased effective substrate range under particular conditions, as compared to each enzyme in the blend individually. As used herein, an "effective substrate range under particular conditions" refers to at least 50% activity (or at least 60%, at least 70% or at least 80% activity) against each substrate in the range under the same defined reaction conditions (e.g., at a particular temperature and pH). For example, a hypothetical enzyme 1 may have an effective substrate range of A, B and C at a specified temperature and pH, and a hypothetical enzyme 2 (having the same EC number as enzyme 1) may have an effective substrate range of C, D and E at that same temperature and pH. A composition comprising a blend of enzyme 1 and enzyme 2 thus may have an effective substrate range of A, B, C, D and E at that temperature and pH. Thus, this effective substrate range of the blend (i.e., A, B, C, D and E) is greater than the effective substrate range of each of the enzymes in the blend individually (i.e., greater than A, B and C for enzyme 1 and greater than C, D and E for enzyme 2).

Accordingly, in one aspect, the invention pertains to a composition comprising a blend of two or more enzymes, wherein each enzyme in the blend has the same Enzyme Commission (EC) number and wherein the effective range of substrates catalyzed by the blend is greater than the effective range of substrates catalyzed by each enzyme in the blend individually.

Additionally, in certain embodiments, the blend may have an increased effective pH range for one or more substrates, as compared to each enzyme in the blend individually. As used herein, an "effective pH range" for an individual enzyme or enzyme blend refers to the pH conditions under which the individual enzyme or enzyme blend exhibits at least 50% activity (or at least 60%, at least 70% or at least 80% activity) against a defined substrate or panel of substrates. For example, a hypothetical enzyme 1 may have an effective pH range of 5.0-6.5, and a hypothetical enzyme 2 (having the same EC number as enzyme 1) may have an effective pH range of 6.0-7.5. A composition comprising a blend of enzyme 1 and enzyme 2 thus may have an effective pH range of 5.0-7.5. Thus, this effective pH range of the blend (i.e., 5.0-7.5) is greater than the effective pH range of each of the enzymes in the blend individually (i.e., greater than 5.0-6.5 for enzyme 1 and greater than 6.0-7.5 for enzyme 2).

Accordingly, in another aspect, the invention pertains to a composition comprising a blend of two or more enzymes, wherein each enzyme in the blend has the same Enzyme Commission (EC) number and wherein the effective pH range of the blend for one or more substrates is greater than the effective pH range of each enzyme in the blend individually.

Additionally, in certain embodiments, the blend may have an increased effective the temperature range for one or more substrates, as compared to each enzyme in the blend individually. As used herein, an "effective temperature range" for an individual enzyme or enzyme blend refers to the temperature conditions under which the individual enzyme or enzyme blend exhibits at least 50% activity (or at least 60%, at least 70% or at least 80% activity) against a defined substrate or panel of substrates. For example, a hypothetical enzyme 1 may have an effective temperature range of 25-30° C., and a hypothetical enzyme 2 (having the same EC number as enzyme 1) may have an effective temperature range of 30-35° C. A composition comprising a blend of enzyme 1 and enzyme 2 thus may have an effective temperature range of 25-35° C. Thus, this effective temperature range of the blend (i.e., 25-35° C.) is greater than the temperature range of each of the enzymes in the blend individually (i.e., greater than 25-30° C. for enzyme 1 and greater than 30-35° C. for enzyme 2).

Accordingly, in another aspect, the invention pertains to a composition comprising a blend of two or more enzymes, wherein each enzyme in the blend has the same Enzyme Commission (EC) number and wherein the effective temperature range of the blend for one or more substrates is greater than the effective temperature range of each enzyme in the blend individually.

In a preferred embodiment, each enzyme in the blend is a beta-glucuronidase (BGUS) enzyme (EC number 3.2.1.31). Accordingly, in another aspect, the disclosure pertains to a composition comprising a blend of two or more beta-glucuronidase enzymes (Enzyme Commission number 3.2.1.31), wherein:

(i) the level of activity of the blend for a range of substrates catalyzed by the blend is synergistically greater than the level of activity for the range of substrates catalyzed by each enzyme in the blend individually;

(ii) the effective range of substrates catalyzed by the blend is greater than the effective range of substrates catalyzed by each enzyme in the blend individually; or (iii) the effective pH range of the blend is greater than the effective pH range of each enzyme in the blend individually; or (iv) the effective temperature range of the blend is greater than the effective temperature range of each enzyme in the blend individually; or (v) any combination of (i)-(iv).

Specific beta-glucuronidase enzymes for use in the blends, preparation thereof and substrates therefor are described in further detail in subsection II below.

Alternatively, in other embodiments, the enzyme blend comprises two or more enzymes from categories other than BGUS enzymes. For example, enzymes that each catalyze the same specific reaction with substrates that contain both a specific and a non-specific structural feature are suitable for blending according to the approaches described herein. In general, enzyme classes according to their EC number are divided as follows: EC1: oxidoreductases (e.g., dehydrogenases, oxidases); EC2: transferases (e.g., transaminases, kinases); EC3: hydrolases (e.g., lipases, amylases, peptidases, phosphatases); EC4: lyases (e.g., decarboxylases); EC5: isomerases (e.g., isomerase, mutase); and EC6: ligases (e.g., synthetase). In one embodiment an enzyme blend of the disclosure comprises two or more sulfatases (EC 3.1.6.1).

In various embodiments, an enzyme blend of the disclosure comprises three or more enzymes having the same EC number, four or more enzymes having the same EC number, five or more enzymes having the same EC number, six or more enzymes having the same EC number, seven or more enzymes having the same EC number, eight or more enzymes having the same EC number, nine or more enzymes having the same EC number or 10 or more enzymes having the same EC number.

In certain embodiments, each enzyme in the blend is purified to at least 90% homogeneity. In certain embodiments, at least one enzyme in the blend is a recombinant enzyme. In certain embodiments, all enzymes in the blend are recombinant enzymes. In certain embodiments, at least one enzyme in the blend is a purified, naturally-occurring enzyme (i.e., a non-recombinant enzyme). In certain embodiments, all enzymes in the blend are purified, naturally-occurring enzymes (i.e., a non-recombinant enzymes). In certain embodiments, the enzymes in the blend are a combination of recombinant enzymes and purified, naturally-occurring (i.e., non-recombinant) enzymes. Specific examples of recombinant and purified, naturally-occurring BGUS enzymes suitable for use in a BGUS enzyme blend of the disclosure are described in further detail in subsection II below.

In the enzyme blends of the disclosure, two or more enzymes are mixed together in different or equal proportions in the composition. The particular fraction to be used for each enzyme in the blend can be determined by the optimization methods described herein (see subsection V and Example 5 below), and further confirmed and/or optimized experimentally as described in Example 6 below, e.g., to select particular fractions in the blend that achieve a synergistic effect across a range of substrates.

In one embodiment, the blend comprises a first enzyme and a second enzyme, wherein the first enzyme comprises up to about 10% of the total protein mass and the second enzyme comprises up to about 90% of the total enzyme mass. In another embodiment, the blend comprises a first enzyme and a second enzyme, wherein the first enzyme comprises up to about 20% of the total protein mass and the second enzyme comprises up to about 80% of the total enzyme mass. In another embodiment, the blend comprises a first enzyme and a second enzyme, wherein the first enzyme comprises up to about 30% of the total protein mass and the second enzyme comprises up to about 70% of the total enzyme mass. In another embodiment, the blend comprises a first enzyme and a second enzyme, wherein the first enzyme comprises up to about 40% of the total protein mass and the second enzyme comprises up to about 60% of the total enzyme mass. In another embodiment, the blend comprises a first enzyme and a second enzyme, wherein the first enzyme comprises up to about 50% of the total protein mass and the second enzyme comprises up to about 50% of the total enzyme mass. As used herein, the term "about" or "approximately", as applied to one or more values of interest, refers to a value that is similar to a stated reference value. In certain embodiments, the term "approximately" or "about" refers to a range of values that fall within 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value). For example, when used in the context of a % amount of enzyme in a blend, "about" may mean+/−5% of the recited value.

In other embodiments, the blend comprises a first enzyme and a second enzyme, wherein the first enzyme comprises 1%-10% of the total protein mass and the second enzyme comprises 90%-99% of the total enzyme mass. In another embodiment, the blend comprises a first enzyme and a second enzyme, wherein the first enzyme comprises 5%-15% of the total protein mass and the second enzyme comprises up to about 85%-95% of the total enzyme mass. In another embodiment, the blend comprises a first enzyme and a second enzyme, wherein the first enzyme comprises 10%-20% of the total protein mass and the second enzyme comprises 80%-90% of the total enzyme mass. In another embodiment, the blend comprises a first enzyme and a second enzyme, wherein the first enzyme comprises 15%-25% of the total protein mass and the second enzyme comprises 75%-85% of the total enzyme mass. In another embodiment, the blend comprises a first enzyme and a second enzyme, wherein the first enzyme comprises 20%-30% of the total protein mass and the second enzyme comprises 70%-80% of the total enzyme mass. In another embodiment, the blend comprises a first enzyme and a second enzyme, wherein the first enzyme comprises 25%-35% of the total protein mass and the second enzyme comprises 65%-75% of the total enzyme mass. In another embodiment, the blend comprises a first enzyme and a second enzyme, wherein the first enzyme comprises 30%-40% of the total protein mass and the second enzyme comprises 60%-70% of the total enzyme mass. In another embodiment, the blend comprises a first enzyme and a second enzyme, wherein the first enzyme comprises 35%-45% of the total protein mass and the second enzyme comprises 55%-65% of the total enzyme mass. In another embodiment, the blend comprises a first enzyme and a second enzyme, wherein the first enzyme comprises 40%-50% of the total protein mass and the second enzyme comprises 50%-60% of the total enzyme mass. In another embodiment, the blend comprises a first enzyme and a second enzyme, wherein the first enzyme comprises 45%-55% of the total protein mass and the second enzyme comprises 45%-55% of the total enzyme mass. The ordinarily skilled artisan will appreciate that other fractions of first and second enzymes are possible and can be determined according to the methods disclosed herein.

Figure 6A:
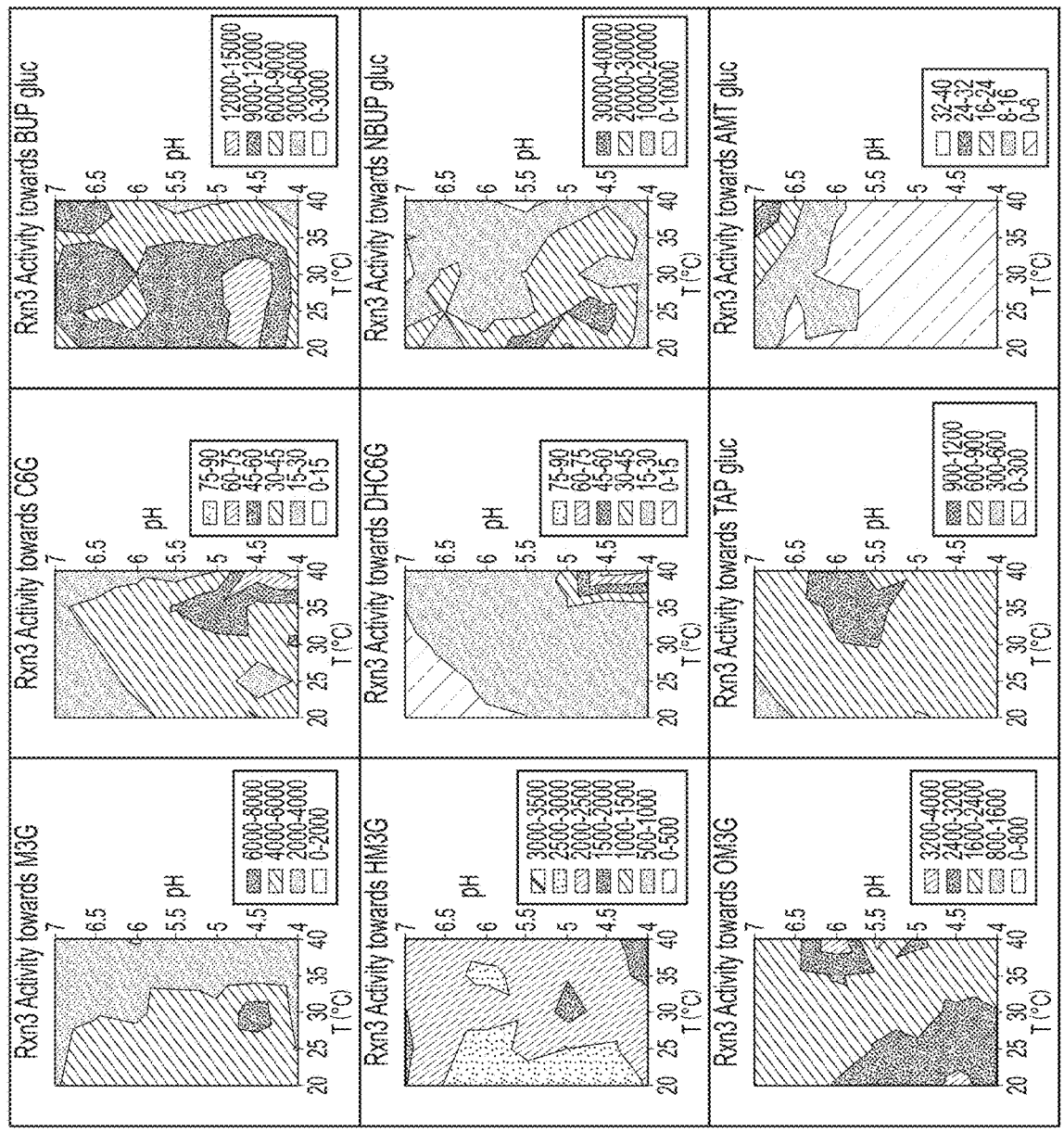
FIGS. 6A-6B are a series of graphs showing the activity surface plots for the chimeric BGUS enzyme Rxn3 on fourteen different glucuronidated drug substrates across the indicated pH and temperature ranges.
Figure 6B:
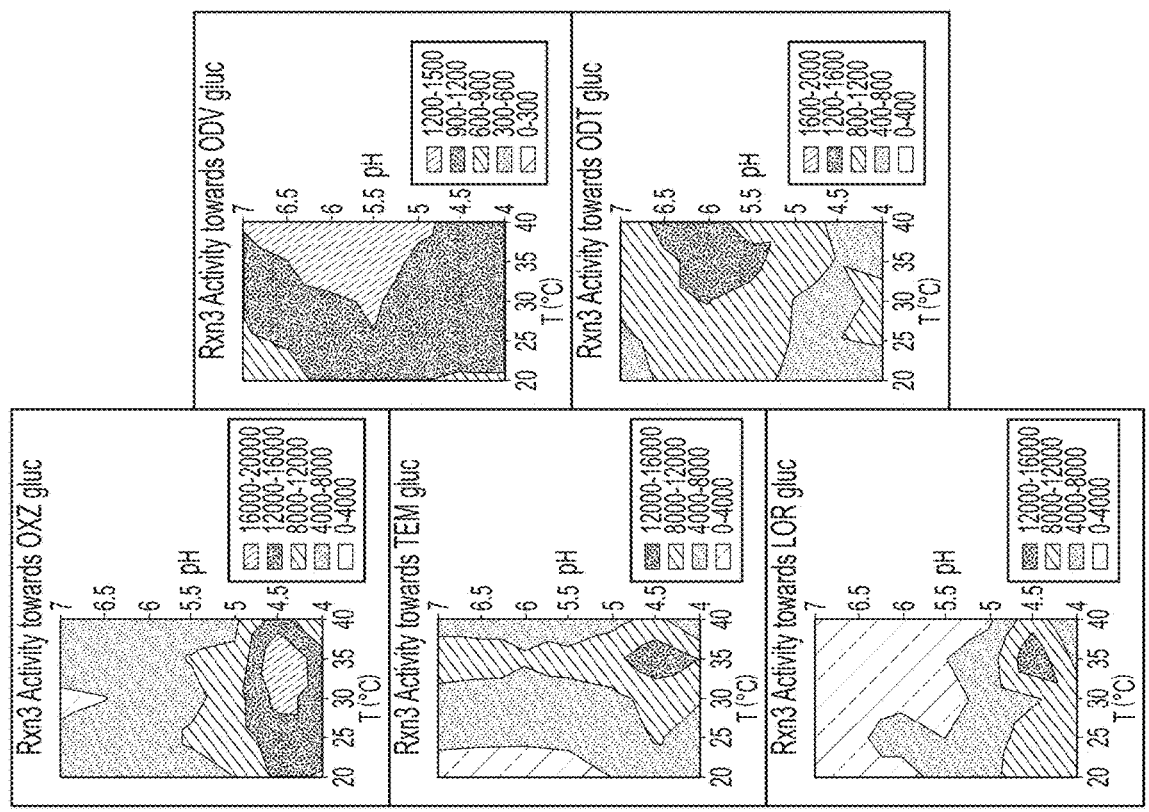

In one embodiment, the blend of the disclosure is a blend of beta-glucuronidases from *Brachyspira pilosicoli* (BpGUS) and *Eubacterium eligens* (EeGUS). BpGUS and EeGUS blends are described in detail in Example 6 and exhibit synergistic activity across a range of substrates (as shown in FIG. 6). In one embodiment, the range of substrates comprises morphine-3-β-D-glucuronide (M3G), oxymorphone-3-β-D-glucuronide (OM3G), hydromorphone-3-β-D-glucuronide (HM3G), codeine-6-β-D-glucuronide (C6G), dihydrocodeine-6-β-D-glucuronide (DHC6G), buprenorphine-3-β-D-glucuronide (BUP gluc), norbuprenorphine-3-β-D-glucuronide (NBUP gluc), tapentadol glucuronide (TAP gluc), O-desmethyltramadol glucuronide (ODT gluc), O-desmethylvenlafaxine glucuronide (ODV gluc), amitriptyline-N-β-D-glucuronide (AMT gluc), oxazepam glucuronide (OXZ gluc), lorazepam glucuronide (LOR gluc) and temazepam glucuronide (TEM gluc).

In one embodiment, the blend comprises about 10%-30% BpGUS and about 70%-90% EeGUS. In another embodiment, the blend comprises about 15%-25% BpGUS and about 75%-85% EeGUS. In another embodiment, the blend comprises about 15% BpGUS and about 85% EeGUS. In another embodiment, the blend comprises about 25% BpGUS and about 75% EeGUS. In another embodiment, the blend comprises 15% BpGUS and 85% EeGUS. In another embodiment, the blend comprises 20% BpGUS and 80% EeGUS. In another embodiment, the blend comprises 25% BpGUS and 75% EeGUS.

In another embodiment, the blend comprises about 10%-30% EeGUS and about 70%-90% BpGUS. In another embodiment, the blend comprises about 15%-25% EeGUS and about 75%-85% BpGUS. In another embodiment, the blend comprises about 15% EeGUS and about 85% BpGUS. In another embodiment, the blend comprises about 25% EeGUS and about 75% BpGUS. In another embodiment, the blend comprises 15% EeGUS and 85% BpGUS. In another embodiment, the blend comprises 20% EeGUS and 80% BpGUS. In another embodiment, the blend comprises 25% EeGUS and 75% BpGUS. In another embodiment, the blend comprises 50% EeGUS and 50% BpGUS.

In other embodiments, the blend comprises about 1-20% BpGUS and about 80-99% EeGUS, or about 20-40% BpGUS and about 60-80% EeGUS, or about 40-60% BpGUS and about 40-60% EeGUS, or about 50% BpGUS and about 50% EeGUS, or about 20-40% EeGUS and about 60-80% BpGUS, or about 1-20% EeGUS and about 80-99% BpGUS.

In certain embodiments, BpGUS comprises an amino acid sequence at least 90% identical (or at least 95%, 96%, 97%, 98%, 99% or 100% identical) to SEQ ID NO: 5. In certain embodiments, BpGUS is a recombinant enzyme. In certain embodiments, BpGUS is a purified, naturally-occurring enzyme.

In certain embodiments, EeGUS comprises an amino acid sequence at least 90% identical (or at least 95%, 96%, 97%, 98%, 99% or 100% identical) to SEQ ID NO: 10.

In certain embodiments, EeGUS is a recombinant enzyme. In certain embodiments, EeGUS is a purified, naturally-occurring enzyme.

In one embodiment, the blend comprises 15%-25% recombinant BpGUS comprising the amino acid sequence shown in SEQ ID NO: 5 and 75%-85% recombinant EeGUS comprising the amino acid sequence shown in SEQ ID NO: 10. In one embodiment, the blend comprises 25% recombinant BpGUS comprising the amino acid sequence shown in SEQ ID NO: 5 and 75% recombinant EeGUS comprising the amino acid sequence shown in SEQ ID NO: 10.

In one embodiment, the blend comprises about 70%-90% EeGUS and about 10%-30% Rxn3. In another embodiment, the blend comprises about 75%-85% EeGUS and about 15%-25% Rxn3. In another embodiment, the blend comprises about 80% EeGUS and about 20% Rxn3. In another embodiment, the blend comprises about 70% EeGUS and about 30% Rxn3. In another embodiment, the blend comprises 80% EeGUS and 20% Rxn3. In another embodiment, the blend comprises 75% EeGUS and 25% Rxn3. In another embodiment, the blend comprises 70% EeGUS and 30% Rxn3.

In another embodiment, the blend comprises about 70%-90% Rxn3 and about 10%-30% EeGUS. In another embodiment, the blend comprises about 75%-85% Rxn3 and about 15%-25% EeGUS. In another embodiment, the blend comprises about 80% Rxn3 and about 20% EeGUS. In another embodiment, the blend comprises about 70% Rxn3 and about 30% EeGUS. In another embodiment, the blend comprises 80% Rxn3 and 20% EeGUS. In another embodiment, the blend comprises 75% Rxn3 and 25% EeGUS. In another embodiment, the blend comprises 70% Rxn3 and 30% EeGUS. In another embodiment, the blend comprises 50% Rxn3 and 50% EeGUS.

In other embodiments, the blend comprises about 1-20% Rxn3 and about 80-99% EeGUS, or about 20-40% Rxn3 and about 60-80% EeGUS, or about 40-60% Rxn3 and about 40-60% EeGUS, or about 50% Rxn3 and about 50% EeGUS, or about 20-40% EeGUS and about 60-80% Rxn3, or about 1-20% EeGUS and about 80-99% Rxn3.

In certain embodiments, EeGUS comprises an amino acid sequence at least 90% identical (or at least 95%, 96%, 97%, 98%, 99% or 100% identical) to SEQ ID NO: 10.

In certain embodiments, EeGUS is a recombinant enzyme. In certain embodiments, EeGUS is a purified, naturally-occurring enzyme.

In certain embodiments, Rxn3 comprises an amino acid sequence at least 90% identical (or at least 95%, 96%, 97%, 98%, 99% or 100% identical) to SEQ ID NO: 19.

In one embodiment, the blend comprises 70%-90% recombinant EeGUS comprising the amino acid sequence shown in SEQ ID NO: 10 and 10%-30% recombinant Rxn3 comprising the amino acid sequence shown in SEQ ID NO: 19. In one embodiment, the blend comprises 70% recombinant EeGUS comprising the amino acid sequence shown in SEQ ID NO: 10 and 30% recombinant Rxn3 comprising the amino acid sequence shown in SEQ ID NO: 19.

II. Beta-Glucuronidase Enzymes

In one embodiment, an enzyme blend of the disclosure comprises two or more beta-glucuronidase enzymes (EC 3.2.1.31). As used herein, the term "beta-glucuronidase enzyme", also referred to as "beta-glucuronidase" or "BGUS", refers to an enzyme that hydrolyzes beta-glucuronide linkages. A BGUS enzyme used in an enzyme blend of the disclosure can be, for example, a wild type enzyme or a mutated enzyme. A "wild type" BGUS enzyme refers to the naturally occurring form of the enzyme. A "mutated" BGUS enzyme refers to a modified form of the enzyme in which one or more modifications, such as amino acid substitutions, deletions and/or insertions, have been made such that the amino acid sequence of the mutated BGUS enzyme differs from the wild type amino acid sequence. In one embodiment, a BGUS enzyme used in an enzyme blend of the disclosure is a recombinant BGUS enzyme. A "recombinant" BGUS enzyme refers to a genetically engineered form of a BGUS enzyme. In another embodiment, a BGUS enzyme used in an enzyme blend of the disclosure is a purified, naturally-occurring BGUS enzyme. A "purified, naturally-occurring" BGUS enzyme refers to an enzyme that has been extracted from a natural biological source.

The sequences of wild type BGUS enzymes from numerous species are known in the art. For example, the nucleotide sequence encoding wild type *E. coli* K12 strain BGUS is shown in NCBI Reference Sequence: NC_000913.2. The amino acid sequence of wild type human (*Homo sapiens*) BGUS (isoform 1 precursor) is shown in NCBI Reference Sequence NP_000172.2. The amino acid sequence of wild type mouse (*Mus musculus*) BGUS (precursor) is shown NCBI Reference Sequence NP_034498.1. The amino acid sequence of wild type *Lactobacillus brevis* BGUS is shown in Genbank Accession No. ACU21612.1. The amino acid sequence of wild type *Staphylococcus* sp. RLH1 BGUS is shown in Genbank Accession No. AAK29422.1. Furthermore, the sequences of a number of microbial BGUS enzymes are disclosed in U.S. Pat. No. 6,391,547 and EP Patent EP 1175495B, the entire contents of which, including the sequence listing, are incorporated herein by reference. Additionally, the nucleotide and amino acid sequence for BGUS from *Brachyspira pilosicoli* is disclosed in U.S. Patent Publication 20180067116, the entire contents of which, including the sequence listing, are incorporated herein by reference.

The sequences of variant BGUS enzymes from numerous species also are known in the art. Suitable variant BGUS enzymes are disclosed in, for example, US Patent Publication 20160090582 (issued as U.S. Pat. No. 9,920,306), US Patent Publication 20160237415 (issued as U.S. Pat. No. 9,719,075), and US Patent Publication 20170267985 (issued as U.S. Pat. No. 9,909,111), the entire contents of each of which, including the sequences, is expressly incorporated herein by reference. Additional variant BGUS enzymes have been described in the art, e.g., in Xiong, A-S. et al. (2007) *Prot. Eng. Design Select.* 20:319-325. Furthermore, a variant BGUS enzyme suitable for use in the invention is commercially available (IMCSzyme®, Integrated Micro-Chromatography Systems, LLC). Still further, additional chimeric and variant BGUS enzymes suitable for use in the invention are described further below.

Furthermore, cloning, recombinant expression and purification of various wild-type and variant BGUS enzymes from different species is described in Examples 1 and 2. The amino acid sequences for BGUS enzymes from *Aspergillus oryzae* (AoGUS), *Aspergillus terreus* (AtGUS), *Bacteriodes fragilis* (BfGUS), *Bacteroides uniformis* (BuGUS), *Brachyspira murdochii* (BmGUS), *Brachyspira pilosicoli* (BpGUS), *Clostridium perfringens* (CpGUS), *Escherichia coli* (EcGUS), IMCSzyme® variant *Escherichia coli* K12 (EcE1F), *Eubacterium eligens* (EeGUS), *Homo sapiens* (HsGUS), *Lactobacillus brevis* (LbLR2D), *Mus musculus* (MmGUS), *Parabacteroides* sp. (PmGUS), *Staphylococcus* sp. (StpGUS) and *Streptococcus agalactiae* (SaGUS) are shown in SEQ ID Nos: 1-16, respectively, and are aligned in FIG. 1.

In one embodiment, at least one enzyme in the blend comprises an amino acid sequence at least 90% identical (or at least 95%, 96%, 97%, 98%, 99% or 100% identical) to one of the amino acid sequences shown in SEQ ID NOs: 1-10. In another embodiment, at least two enzymes in the blend comprise an amino acid sequence at least 80% identical (or at least 85%, 90%, 95%, 96%, 97%, 98%, 99% or 100% identical) to one of the amino acid sequences shown in SEQ ID NOs: 1-16. In yet another embodiment, at least three enzymes in the blend comprise an amino acid sequence at least 80% identical (or at least 85%, 90%, 95%, 96%, 97%, 98%, 99% or 100% identical) to one of the amino acid sequences shown in SEQ ID NOs: 1-16. In one embodiment, at least one of the enzymes in the blend comprises the amino acid sequence shown in SEQ ID NO: 9 (corresponding to the IMCSzyme® mutant *Escherichia coli* K12 BGUS enzyme).

For amino acid sequences, as used herein the term "% homology" or "% identity" indicates that when two sequences are aligned and compared, with appropriate amino acid insertions or deletions for optimal alignment, at least about 80% of the amino acids, usually at least about 85% or 90% or 95%, 96%, 97%, 98%, 99% or 100%, are identical between the two sequences. The percent identity between two sequences is a function of the number of identical positions shared by the sequences (i.e., % homology/identity=# of identical positions/total # of positions× 100), taking into account the number of gaps, and the length of each gap, which need to be introduced for optimal alignment of the two sequences. The comparison of sequences and determination of percent identity between two sequences can be accomplished using a mathematical algorithm, non-limiting examples of which below are described below.

The percent identity between two amino acid sequences can also be determined using the algorithm of E. Meyers and W. Miller (CABIOS, 4:11-17 (1989)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch ((1970) *J. Mol. Biol.* 48:444-453) algorithm which has been incorporated into the GAP program in the GCG software package (available at http://www.gcg.com), using either a Blossum 62 matrix or a PAM250 matrix, and a gap weight of 16, 14, 12, 10, 8, 6, or 4 and a length weight of 1, 2, 3, 4, 5, or 6. Other suitable means for determining percent identity between two amino acid sequences are well-established in the art.

Additional or alternative to the use of recombinant BGUS enzymes, a BGUS enzyme blend of the disclosure can comprise at least one purified, naturally-occurring BGUS enzyme (i.e., an enzyme that has been extracted from a natural biological source).

Suitable natural biological sources for purification of a naturally-occurring BGUS enzyme include bacteria and mollusks (e.g., snail, abalone, limpet). In one embodiment, at least one enzyme in the blend is purified from a mollusk source. In one embodiment, the mollusk source is selected from the group consisting of Helix, Haliotis, Cornu and Patella. In one embodiment, the mollusk source is selected from the group consisting of *Helix pomatia, Helix aspera, Haliotis rufescens* and *Patella vulgata*. Naturally-occurring BGUS enzymes extracted from a natural biological source (e.g., snail, abalone, limpet) are commercially available in the art or can be purified using standard methodology known in the art.

In one embodiment, a BGUS enzyme blend of the disclosure comprises entirely recombinant BGUS enzymes. In another embodiment, a BGUS enzyme blend of the disclosure comprises entirely purified, naturally-occurring BGUS enzymes. In yet another embodiment, a BGUS enzyme blend of the disclosure comprises a combination of recombinant BGUS enzymes and naturally-occurring BGUS enzymes.

In certain embodiments, each enzyme in the blend is purified to at least 80% (more preferably at least 85%, 90%, 95%, 96%, 97%, 98%, 99% or 100%) homogeneity. In certain embodiments, the BGUS enzyme blend is substantially free of other non-BGUS proteins. As used herein, "substantially free" refers to less than 10%, preferably less than 5%, 4%, 3%, 2% or even more preferably less than 1% of contamination non-BGUS proteins.

BGUS enzyme blends can be prepared such that the blend is capable of catalyzing a desired range of substrates (e.g., for a particular clinical or forensic purpose). In one embodiment, the range of substrates catalyzed by the BGUS enzyme blend comprises glucuronidated metabolites of drugs comprising opiates, synthetic opioids, anti-depressants and benzodiazepines. In one embodiment, the range of substrates catalyzed by the BGUS enzyme blend comprises glucuronidated opiates comprising morphine-3-β-D-glucuronide, hydromorphone-3-β-D-glucuronide, oxymorphone-3-β-D-glucuronide, codeine-6-β-D-glucuronide and dihydrocodeine-6-β-D-glucuronide. In one embodiment, the range of substrates catalyzed by the BGUS enzyme blend comprises glucuronidated opioids comprising buprenorphine glucuronide, norbuprenorphine glucuronide and tapentadol glucuronide. In one embodiment, the range of substrates catalyzed by the BGUS enzyme blend comprises glucuronidated anti-depressants comprising O-desmethyl-venlafaxine glucuronide and amitriptyline-N-β-D-glucuronide. In one embodiment, the range of substrates catalyzed by the BGUS enzyme blend comprises glucuronidated benzodiazepines comprising temazepam glucuronide, oxazepam glucuronide and lorazepam glucuronide. In yet another embodiment, the range of substrates catalyzed by the BGUS enzyme blend comprises the panel of fourteen substrates set forth in Example 4.

A. Chimeric BGUS Enzymes

In one embodiment, one or more of the enzymes used in an enzyme blend of the disclosure is a chimeric BGUS enzyme. Suitable chimeric BGUS enzymes are described in detail in U.S. Provisional Application No. 62/742,779, filed Oct. 8, 2018, the entire contents of which is hereby incorporated by reference.

In one embodiment, the chimeric beta-glucuronidase (BGUS) enzyme comprises an N-terminal sugar-binding/Ig-like domain (SBI domain) and a C-terminal TIM-Barrel domain (TIMB domain) comprising a Loop 1 domain, wherein the chimeric BGUS enzyme comprises:

(a) an SBI domain from a first BGUS enzyme and a TIMB domain and Loop 1 domain from a second BGUS enzyme; or (b) an SBI domain from a first BGUS enzyme, a TIMB domain from a second BGUS enzyme, and a Loop 1 domain from the first BGUS enzyme; or (c) an SBI domain and a TIMB domain from a first BGUS enzyme and a Loop 1 domain from a second BGUS enzyme.

Non-limiting examples of chimeric BGUS enzymes having an SBI domain from a first BGUS enzyme and a TIMB domain and Loop 1 domain from a second BGUS enzyme include those having any of the amino acid sequences shown in SEQ ID NOs: 17-24. In a preferred embodiment, the chimeric enzyme is Rxn3, which has the amino acid sequence shown in SEQ ID NO: 19.

Non-limiting examples of chimeric BGUS enzymes having an SBI domain from a first BGUS enzyme, a TIMB domain from a second BGUS enzyme, and a Loop 1 domain from the first BGUS enzyme include those having any of the amino acid sequences shown in SEQ ID NOs: 25-30.

Non-limiting examples of chimeric BGUS enzymes having an SBI domain and a TIMB domain from a first BGUS enzyme and a Loop 1 domain from a second BGUS enzyme include those having any of the amino acid sequences shown in SEQ ID NOs: 31-36.

In another embodiment, the chimeric BGUS enzyme comprises a TIM-Barrel domain (TIMB domain) comprising a Counter-loop domain and a Loop 1 domain, wherein the chimeric BGUS enzyme comprises:

(a) a TIMB domain from a first BGUS enzyme, a Counter-loop domain from a second BGUS enzyme and a Loop 1 domain from the first BGUS enzyme; or (b) a TIMB domain from a first BGUS enzyme, a Counter-loop domain from the first BGUS enzyme and a Loop 1 domain from a second BGUS enzyme; or (c) a TIMB domain from a first BGUS enzyme, a Counter-loop domain from a second BGUS enzyme and a Loop 1 domain from the second BGUS enzyme.

Non-limiting examples of chimeric BGUS enzymes having the aforementioned TIMB domain, Counter-loop domain, Loop 1 domain swaps include those having any of the amino acid sequences shown in SEQ ID NOs: 37-46.

B. Variant BGUS Enzymes

In one embodiment, one or more of the enzymes used in an enzyme blend of the disclosure is a variant BGUS enzyme having one or more amino acid substitutions as compared from a parental BGUS enzyme from which the variant BGUS enzyme is derived. Suitable variant BGUS enzymes are described in detail in U.S. Provisional Application No. 62/742,779, filed Oct. 8, 2018, the entire contents of which is hereby incorporated by reference.

In one embodiment, the variant BGUS enzyme comprises an amino acid sequence at least 80% homologous to an amino acid sequence shown in SEQ ID NOs: 1-46 and comprises at least one amino acid substitution, as compared to the parental BGUS enzyme, at at least one amino acid position corresponding to F294, T295, I450, Q451, A452 and/or G563 of SEQ ID NO: 5.

Non-limiting examples of variant BGUS enzymes having a single amino acid substitution at a position corresponding to F294, T295, I450, Q451, A452 and/or G563 of SEQ ID NO: 5 include those having any of the amino acid sequences shown in SEQ ID NOs: 47-100.

Non-limiting examples of variant BGUS enzymes having double amino acid substitutions at two position corresponding to F294, T295, I450, Q451, A452 and/or G563 of SEQ ID NO: 5 include those having any of the amino acid sequences shown in SEQ ID NOs: 101-117.

In another embodiment, the variant BGUS enzyme comprises an amino acid sequence at least 80% homologous to an amino acid sequence shown in SEQ ID NOs: 1-46 and comprises at least one cysteine substitution, as compared to the parental BGUS enzyme, at at least one amino acid position corresponding to Q8, S73, P489, Q570 or K588 of SEQ ID NO: 10.

Non-limiting examples of variant BGUS enzymes having at least one cysteine substitution at a position corresponding to Q8, S73, P489, Q570 or K588 of SEQ ID NO: 10 include those having any of the amino acid sequences shown in SEQ ID NOs: 118-120.

III. Formulations of Enzyme Blends

The compositions of the disclosure comprising an enzyme blend can be included in formulations that contain additional substances and/or that are formulated in a particular way. For example, the formulations of the disclosure can be either liquid (aqueous) or lyophilized (freeze-dried). Liquid formulations typically allow for maintenance of enzymatic activity even after cycles of freezing/thawing. Lyophilized formulations typically maintain enzymatic activity over a wide temperature range, including high temperatures. Typically, a formulation comprises the enzyme blend composition and at least one excipient. Non-limiting examples of excipients that can be included in a formulation include water, salts, buffers, sugars and amino acids. Certain BGUS enzyme formulations have been described in the art, such as in PCT Application No. PCT/US2017/14387, the entire contents of which is expressly incorporated herein by reference.

Aqueous and lyophilized formulations can be prepared using methods well established in the art. Typically, an aqueous formulation is prepared by combining the enzymes and the excipient(s) at the desired concentrations. A lyophilized formulation can be made by freeze-drying the aqueous formulation using techniques well established in the art.

In certain embodiments, one or more sugars are used in the formulation. In one embodiment, the sugar is a polyol. In certain embodiments, the sugar(s) used in the formulation is selected from the group consisting of sucrose, sorbitol, xylitol, glycerol, 2-hydroxypropyl-3-cyclodextrin and α-cyclodextrin. In a preferred embodiment, the sugar is sucrose.

In certain embodiments, the sugar is present in the formulation at a concentration of at least 10 mM, or at least 25 mM or at least 50 mM or at least 100 mM. In other embodiments, the sugar is present in the formulation at a concentration of 10-1000 mM, or 25-500 mM or 50 mM-250 mM or 50 mM-500 mM or 50 mM-1000 mM. In other embodiments, the sugar is present in the formulation at a concentration of 50 mM or 75 mM or 100 mM or 200 mM or 250 mM or 300 mM or 400 mM or 500 mM or 600 mM or 700 mM or 750 mM or 800 mM or 900 mM or 1000 mM.

In certain embodiments, one or more amino acids (e.g., beta-alanine, L-histidine) is present in the formulation at a concentration of at least 25 mM or at least 50 mM. In other embodiments, the amino acid(s) is present in the formulation at a concentration of 25-500 mM or 50 mM-250 mM or 50 mM-500 mM. In other embodiments, the amino acid(s) is present in the formulation at a concentration of 25 mM or 30 mM or 40 mM or 50 mM or 75 mM or 100 mM or 200 mM or 250 mM or 300 mM or 400 mM or 500 mM.

In certain embodiments, each BGUS enzyme in the enzyme blend is present in the formulation at a concentration of at least 0.1 mg/mL. In certain embodiments, at least one BGUS enzyme is present in the formulation at a concentration of at least 1 mg/mL or at least 2.5 mg/mL or at least 5 mg/mL or at least 10 mg/mL. In other embodiments, at least one BGUS enzyme is present in the formulation at a concentration of 1-10 mg/mL or 1-5 mg/mL or 2.5-10 mg/mL or 2.5-5 mg/mL. In other embodiments, at least one BGUS enzyme is present in the formulation at a concentration of 1 mg/mL or 2 mg/mL or 3 mg/mL or 4 mg/mL or 5 mg/mL or 6 mg/mL or 7 mg/mL or 8 mg/mL or 9 mg/mL or 10 mg/mL.

In certain embodiments, at least one BGUS enzyme in the formulation has an enzymatic activity of at least 5,000 Units/mL or 5,000 Units/mg, more preferably at least 10,000 Units/mL or 10,000 Units/mg, even more preferably at least 25,000 Units/mL or 25,000 Units/mg and even more preferably 50,000 Units/mL or 50,000 Units/mg. The specific activity of the enzyme in the preparation, in Units/mL or Units/mg, can be determined using a standardized glucuronide linkage hydrolysis assay using phenolphthalein-glucuronide as the substrate. The standardization of the specific activity of BGUS has been well established in the art. Thus, 1 Fishman unit of BGUS activity is defined as an amount of enzyme that liberates 1 μg of phenolphthalein from phenolphthalein-glucuronide in 1 hour. An exemplary standardized assay that can be used to determine the specific activity (in Units/mL or Units/mg) of an enzyme preparation is described in further detail in Example 3. The skilled artisan will appreciate that other protocols for the enzyme assay are also suitable (e.g., such as those described by Sigma Aldrich Chemical Co.).

In one embodiment, the formulation is free of detergents, such as surfactants (e.g., Tween compounds and the like). Since the presence of detergents in a BGUS formulation can interfere with mass spectrometry (MS) analysis, the lack of detergent(s) in the formulation of the invention imparts the advantage that the formulation can be used directly in analysis of biological samples to be assayed by MS.

In one embodiment, the formulation is free of polymers (e.g., synthetic polymers and the like). Since the presence of polymers in a BGUS formulation can interfere with mass spectrometry (MS) analysis, the lack of polymer(s) in the formulation of the invention imparts the advantage that the formulation can be used directly in analysis of biological samples to be assayed by MS.

In one embodiment, the formulation is an aqueous (liquid) formulation. In another embodiment, the formulation is a lyophilized (freeze-dried) formulation.

Packaged formulations, comprising a formulation of the disclosure and a container, are also encompassed. Non-limiting examples of suitable containers for use in a packed formulation include, bottles, tubes, vials, ampules and the like. Preferably, the container is glass or plastic, although other suitable materials are known in the art. Non-limiting examples of suitable instruction media include labels, pamphlets, inserts, and digital media.

IV. Methods of Using Enzyme Blends

The enzyme blend compositions and formulations of the disclosure can be used to catalyze a range of substrates according to the type of enzyme (EC number) used in the blend. Since the enzyme blends exhibit a greater substrate range (and may exhibit a greater pH range and/or temperature range) than each individual enzyme included in the blend, the methods of using the enzyme blends as described herein allow for more efficient catalysis of a range of substrates as compared to use of individual enzymes.

Accordingly, in one embodiment, the invention pertains to a method of catalyzing a range of substrates, the method comprising contacting the range of substrates with an enzyme blend composition or the formulation of the disclosure under conditions such that catalysis of the range of substrates occurs. In various embodiments, the range of substrates comprises at least two substrates, at least three substrates, at least four substrates, at least five substrates, at least six substrates, at least seven substrates, at least eight substrates, at least nine substrates, at least ten substrates, at least eleven substrates, at least twelve substrates, at least thirteen substrates, at least fourteen substrates or at least fifteen substrates. In various embodiments, the enzyme blend comprises at least two enzymes, at least three enzymes, at least four enzymes, at least five enzymes, at least six enzymes, at least seven enzymes, at least eight enzymes, at least nine enzymes, at least ten enzymes, at least eleven enzymes, at least twelve enzymes, at least thirteen enzymes, at least fourteen enzymes or at least fifteen enzymes.

In one embodiment, the enzyme blend is a BGUS enzyme blend. Accordingly, in another embodiment, the invention pertains to a method of hydrolyzing a range of substrates comprising a glucuronide linkage, the method comprising contacting the range of substrates with a BGUS enzyme blend composition or formulation of the disclosure under conditions such that hydrolysis of the glucuronide linkage in the range of substrates occurs. In various embodiments, the range of substrates comprises at least two BGUS substrates, at least three BGUS substrates, at least four BGUS substrates, at least five BGUS substrates, at least six BGUS substrates, at least seven BGUS substrates, at least eight BGUS substrates, at least nine BGUS substrates, at least ten BGUS substrates, at least eleven BGUS substrates, at least twelve BGUS substrates, at least thirteen BGUS substrates, at least fourteen BGUS substrates or at least BGUS fifteen substrates. In one embodiment, the range of BGUS substrates includes codeine-6-β-D-glucuronide. In various embodiments, the enzyme blend comprises at least two BGUS enzymes, at least three BGUS enzymes, at least four BGUS enzymes, at least five BGUS enzymes, at least six BGUS enzymes, at least seven BGUS enzymes, at least eight BGUS enzymes, at least nine BGUS enzymes, at least ten BGUS enzymes, at least eleven BGUS enzymes, at least twelve BGUS enzymes, at least thirteen BGUS enzymes, at least fourteen BGUS enzymes or at least fifteen BGUS enzymes.

These BGUS enzyme blend methods can be used, for example, for clinical purposes, for forensic purposes, for industrial manufacturing purposes or for agricultural purposes. These methods are particularly useful for analyzing bodily samples for the presence of drugs through detection of the glucuronide detoxification products of the drugs, e.g., for clinical or forensic purposes. Additionally, beta-agonists have been used in meat husbandry, since they can promote muscle growth instead of fat growth in animals (see e.g., *J. Animal Sci.* (1998) 76:195-207). Thus, the BGUS enzyme formulations also can be used for agricultural purposes in detecting beta-agonist residues in meat products.

In one embodiment, the range of substrates comprises opiate glucuronides. Non-limiting examples of suitable opiate glucuronide substrates include morphine-3-β-D-glucuronide, morphine-6-β-D-glucuronide, codeine-6-β-D-glucuronide, hydromorphone-3-β-D-glucuronide, oxymorphone-3-β-D-glucuronide, and combinations thereof.

In another embodiment, the range of substrates comprises benzodiazepine glucuronides. Non-limiting examples of suitable benzodiazepine glucuronide substrates include the glucuronides of oxazepam, lorazepam, temazepam, and alpha-hydroxy-alprazolam.

Other suitable ranges of substrates include the glucuronides of buprenorphine, norbuprenorphine, 11-nor-A9-tetrahydrocannabinol-9-carboxylic acid, testosterone, androsterone, tapentadol, cyclobenzaprine, amitriptyline and combinations thereof.

In another embodiment, the range of substrates catalyzed by the BGUS enzyme blend comprises glucuronidated metabolites of drugs comprising opiates, synthetic opioids, anti-depressants and benzodiazepines. In another embodiment, the range of substrates catalyzed by the BGUS enzyme blend comprises glucuronidated opiates comprising morphine-3-β-D-glucuronide, hydromorphone-3-β-D-glucuronide, oxymorphone-3-β-D-glucuronide, codeine-6-β-D-glucuronide and dihydrocodeine-6-β-D-glucuronide. In another embodiment, the range of substrates catalyzed by the BGUS enzyme blend comprises glucuronidated opioids comprising buprenorphine glucuronide, norbuprenorphine glucuronide and tapentadol glucuronide. In another embodiment, the range of substrates catalyzed by the BGUS enzyme blend comprises glucuronidated anti-depressants comprising O-desmethylvenlafaxine glucuronide and amitriptyline-N-β-D-glucuronide. In another embodiment, the range of substrates catalyzed by the BGUS enzyme blend comprises glucuronidated benzodiazepines comprising temazepam glucuronide, oxazepam glucuronide and lorazepam glucuronide. In yet another embodiment, the range of substrates catalyzed by the BGUS enzyme blend comprises the panel of fourteen substrates set forth in Example 4.

In one embodiment, the range of substrates comprises at least one beta-agonist (e.g., for meat product analysis). Non-limiting examples of suitable beta-agonist glucuronidated substrates include clenbuterol, ractopamine and salbutamol.

In one embodiment, the range of substrates is in a sample of blood, urine, tissue or meconium obtained from a subject. The methods of the invention can be used on a variety of different bodily samples. Non-limiting examples of suitable bodily samples include blood, urine, tissue or meconium obtained from a subject. For meat product analysis, the bodily sample can be a meat sample. Bodily samples can be obtained, stored and prepared for analysis using standard methods well established in the art.

Following hydrolysis by the enzyme, the cleavage products in the sample can be analyzed by standard methodologies, such as high performance liquid chromatography (HPLC), gas chromatography (GC) and/or mass spectrometry (MS). Such approaches for analysis of bodily samples for the presence of drugs are well established in the art. For example, a completely automated workflow for the hydrolysis and analysis of urine samples by LC-MS/MS, which can be applied using the variant enzymes of the invention for hydrolysis, is described in Cabrices, O. G. et al., GERSTEL AppNote AN/2014/4-7.

Additional liquid chromatography and tandem mass spectrometry (LC-MS/MS) methodologies suitable for use with the invention are described in Sitasuwan et al. (2016) *J. Analytic. Toxicol.* 40:601-607. Methods for detecting beta-agonist residues in meat products using UPLC-MS/MS have also been described (www.waters.com/webassets/cms/library/docs/720004388en.pdf).

V. Optimization and Preparation of Enzyme Blends

The disclosure provides approaches and methods for optimizing the ratios of two or more enzymes in an enzyme blend such that the blend exhibits enhanced properties as compared to each enzyme alone. Thus, the disclosure allows for the preparation of an optimized enzyme blend for use with a panel (range) of substrates, which poses a significantly greater technical challenge than enzymatic cleavage of a single substrate alone.

For a single specific substrate, such as a glucuronidated drug molecule, under defined conditions of temperature and pH, within a panel of enzymes there will be one enzyme that has superior hydrolysis capacity, relative to all the other enzymes. Hydrolysis capacity might be defined as either the rate at which it hydrolyzes the substrate (highest rate) or the dose required to hydrolyze a certain amount within a certain time under defined conditions (minimum dose). For a single enzyme-substrate pair, these values are related and reciprocal.

However, in the field of clinical and forensic drug testing, laboratories want to test for a panel of drug molecules that may include tens to hundreds of substrates. As discussed above, for each substrate there will be one superior enzyme, but this may be a different enzyme for each substrate. Thus, the situation becomes more complex when there are at least two substrates to hydrolyze and at least two enzymes available for the blend. The disclosure provides two methods for calculating optimal blends of enzymes to hydrolyze a panel of substrates under different defined conditions, each having a different intent with respect to the strategy used for optimization, as discussed further below.

The first approach (referred to herein as Model 1) identifies the ratios to be used in a blend to achieve the fastest weighted-average kinetic for all substrates. Thus, since Model 1 is based on the use of a weighted average of activity for all substrates, Model 1 provides ratios for a blend that results in "good" activity against all substrates in the panel under specified conditions (e.g., pH and temperature), while potentially somewhat compromising the "best" activity of one or more enzymes in the blend against one or more substrates in the panel.

The second approach (referred to herein as Model 2) identifies the ratios to be used in a blend to achieve the minimum dose for complete hydrolysis of all substrates in the panel, including the most recalcitrant substrate, in a specified time. Thus, since Model 2 is based on the complete hydrolysis of all substrates in the panel within a specified time, it provides the optimal ratios for achieving hydrolysis of the "weakest link" (i.e., the most recalcitrant substrate) as well as the other substrates in the panel. Thus, Model 2 can be a more practical model for use with a panel of substrates that includes at least one recalcitrant (i.e., difficult to cleave) substrate. For example, it is known in the art that among the glucuronide substrates typically examined in clinical and forensic drug testing, codeine-6-β-D-glucuronide is more recalcitrant to cleave by BGUS than other substrates (see e.g., Lin et al. (1994) *J. Anal. Toxicol.* 18:129-133; Wang et al. (2006) *J. Anal. Toxicol.* 30:570-575). Thus, for substrate panels that include codeine-6-β-D-glucuronide, Model 2 is an appropriate model to use to obtain the optimal ratios for a blend to achieve complete hydrolysis of codeine-6-β-D-glucuronide within a specified time.

Comparing the two models, Model 2 is more strictly dependent upon the particular substrates used to define the blend and also includes time as a pre-condition, whereas Model 1 is open ended and defined only by pH and temperature (which are defined pre-conditions for both models). For particular enzymes and substrates under specified pH and temperature conditions, the ordinarily skilled artisan will appreciate that the optimal blend ratios may differ for the optimized weighted average activity (Model 1) as compared to the minimum dose (Model 2). Moreover, given the disclosure herein, the ordinarily skilled artisan can readily choose the appropriate model to use and determine the appropriate ratios to select for a desired enzyme blend for use with a particular panel of substrates. For example, FIGS. 10A-B and 11A-B show comparisons of the optimal ratios for two different enzyme blends using the two different models across of range of pH and temperature conditions.

Methodologies for optimizing enzyme blends of the disclosure are also described in detail in Examples 3-5. To prepare a blend of enzymes having optimized activity against a range of substrates, the specific activity of each enzyme on each substrate at a given temperature and pH must either be already known or determined experimentally. For BGUS enzymes, a standard enzymatic activity assay, using phenolphthalein-β-D-glucuronide (PTGlcU) as the substrate, is described in Example 3 and can used to determine enzyme activity across a range of pH and/or a range of temperatures. Thus, this type of assay (or other suitable BGUS activity assay known in the art) can be used to determine the optimum pH and/or temperature range for each BGUS enzyme of interest individually against a standard substrate. Moreover, similar suitable enzymatic activity assays for other classes of enzymes (e.g., sulfatases) also are well-established in the art.

Figure 4A:
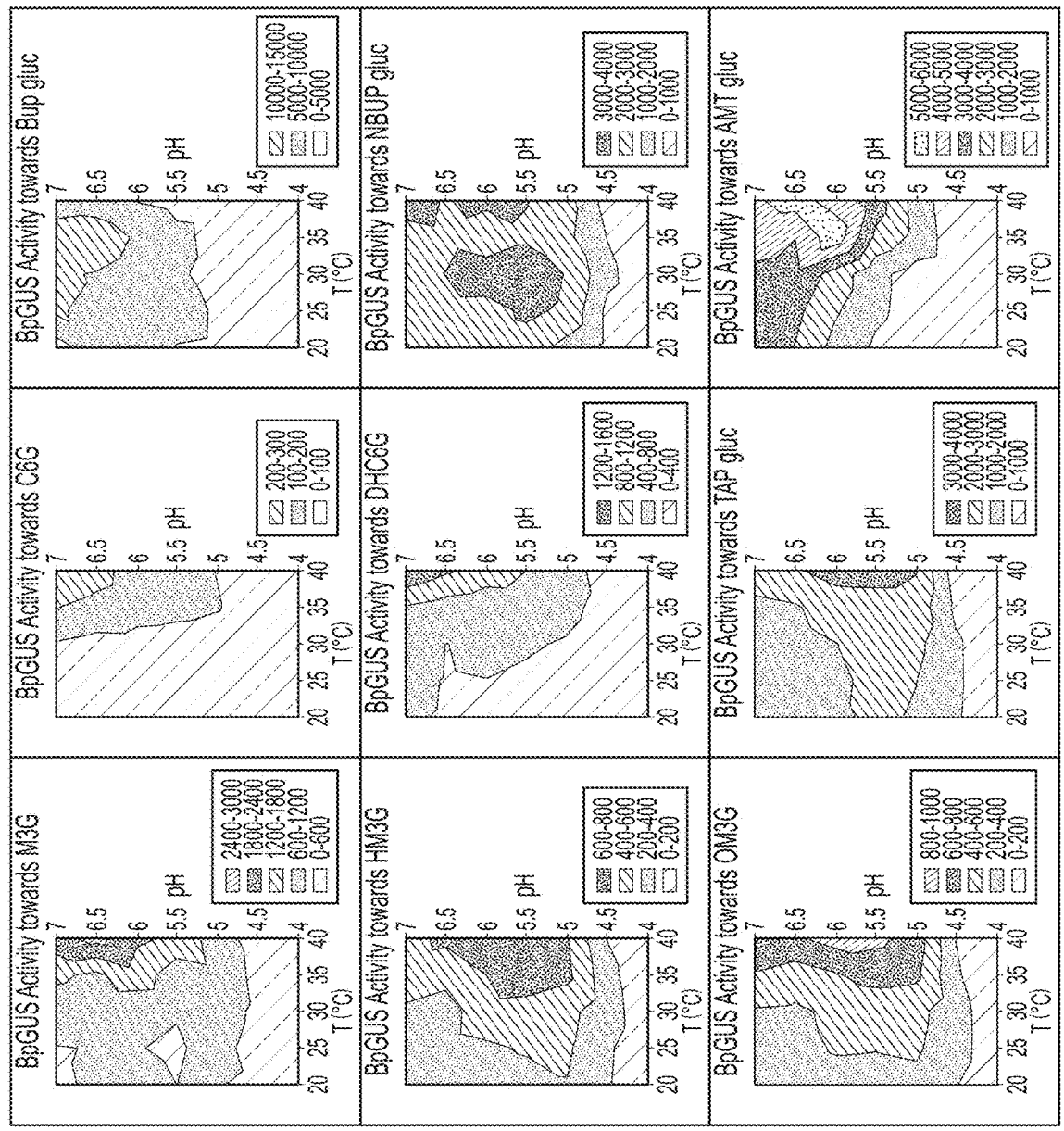
FIGS. 4A-4B are a series of graphs showing the activity surface plots for BpGUS on fourteen different glucuronidated drug substrates across the indicated pH and temperature ranges.
Figure 4B:
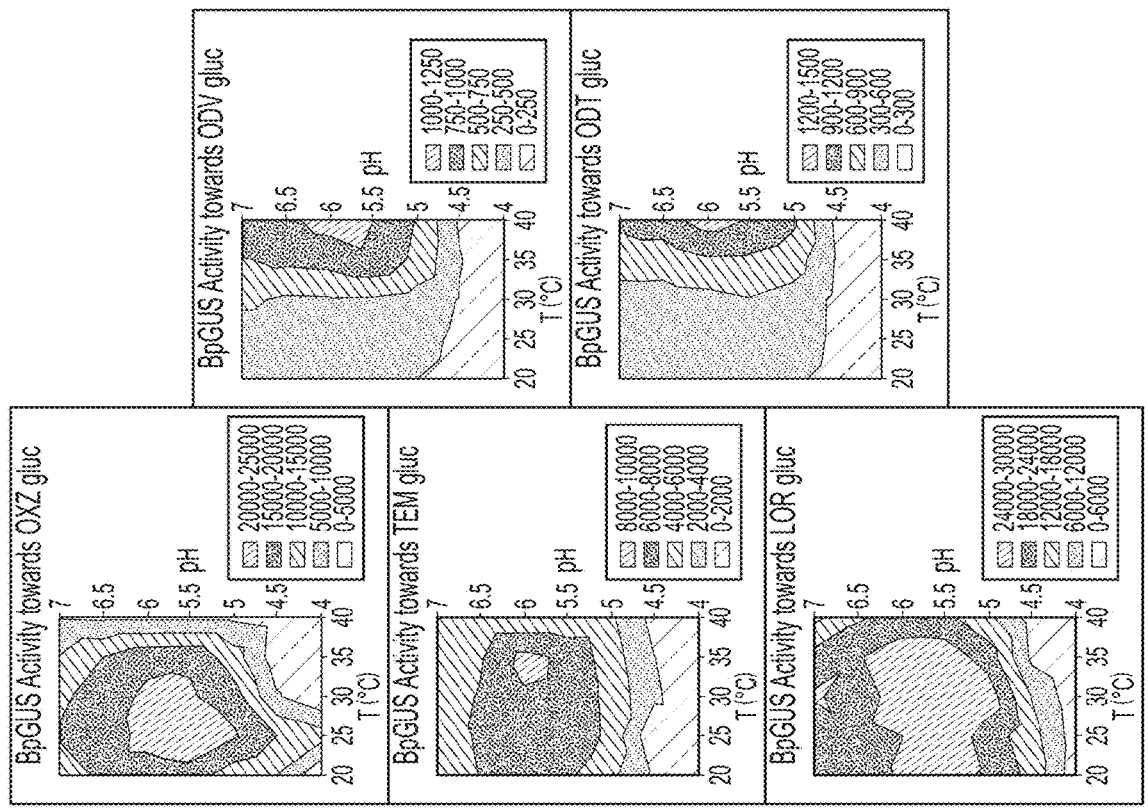
Figure 5A:
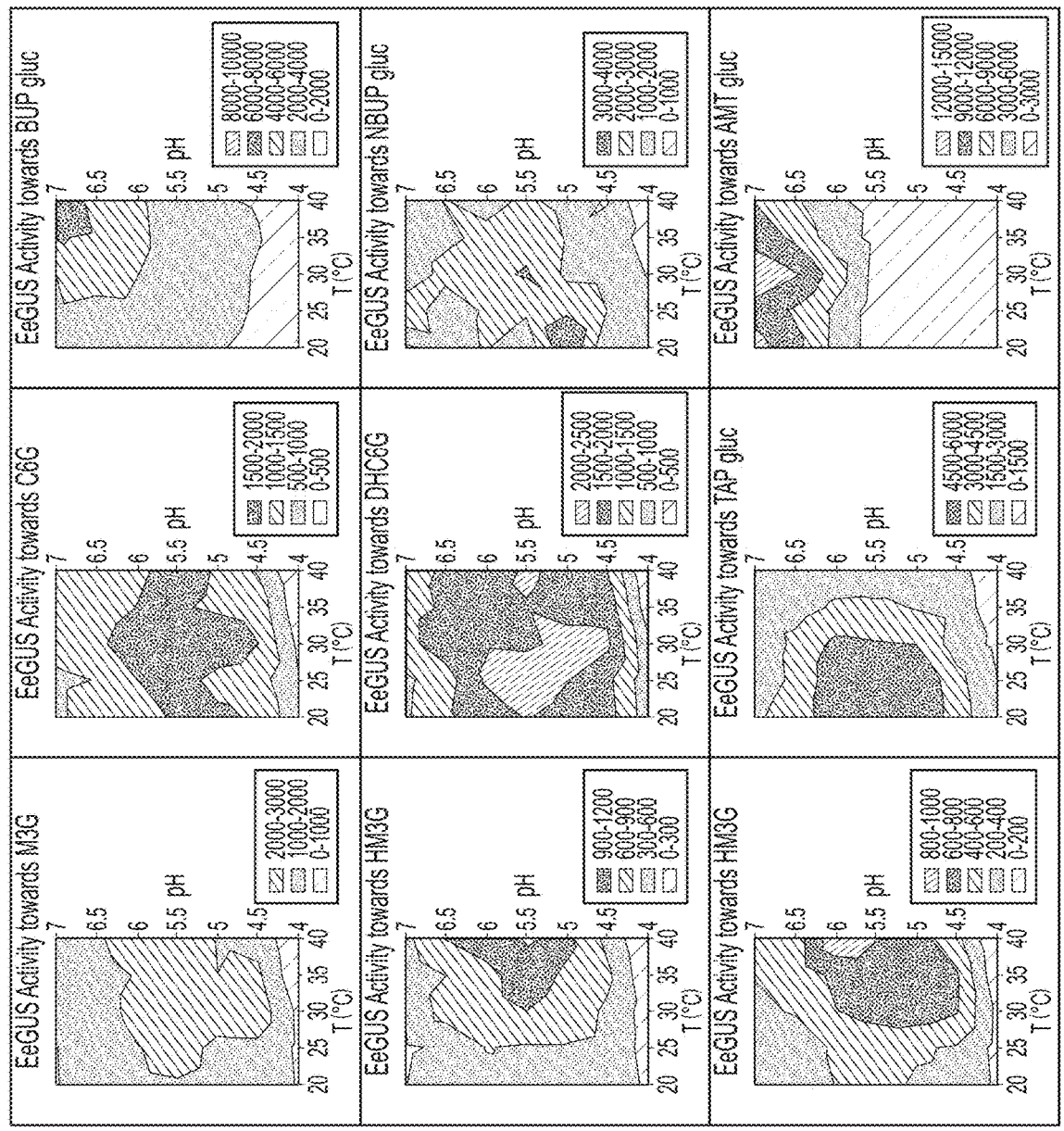
FIGS. 5A-5B are a series of graphs showing the activity surface plots for EeGUS on fourteen different glucuronidated drug substrates across the indicated pH and temperature ranges.
Figure 5B:
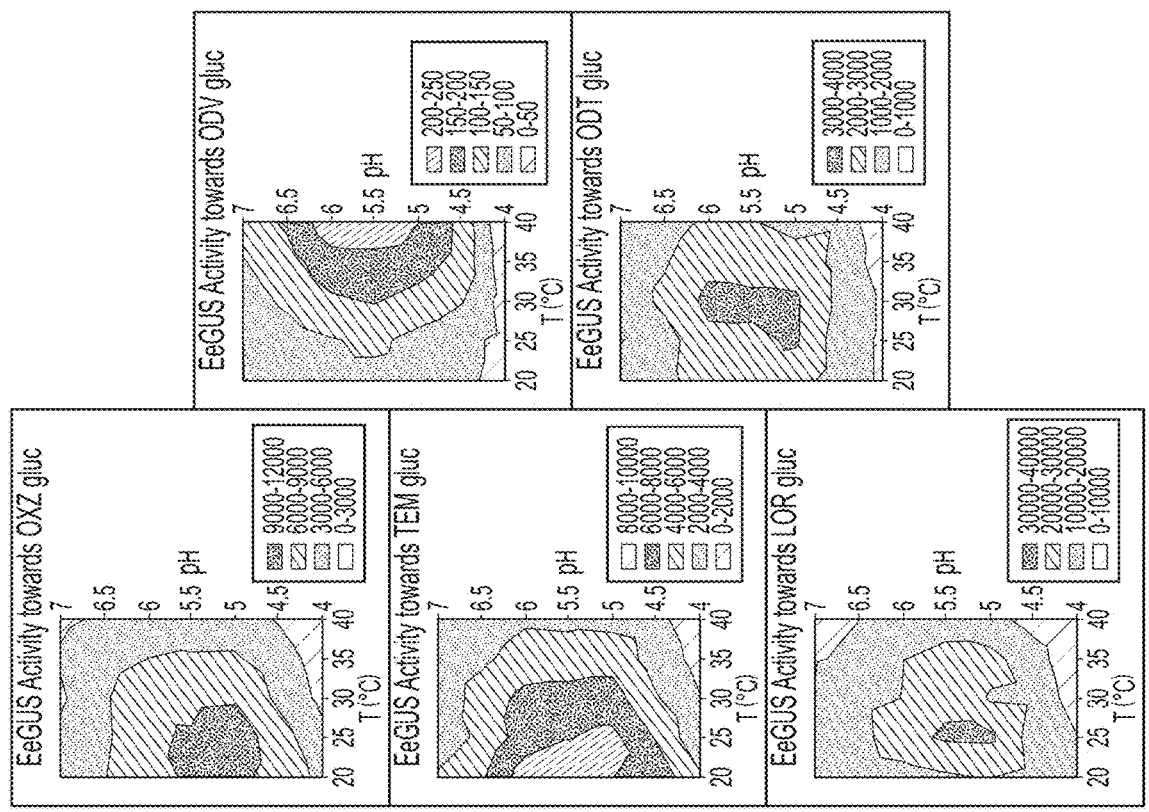

Furthermore, as described in detail in Example 4, activity surface plots can be prepared for each BGUS enzyme of interest individually using a panel of substrates, thereby determining activity across a range of pH and temperatures for each substrate in the panel. One approach is to measure the activity of each individual enzyme against a panel of substrates at the enzyme's optimal pH and the preferred assay temperature, then multiply these values over the pH and temperature profiles (either actual or modeled) to create activity surfaces for each enzyme/substrate pair. Alternatively, these values can be measured directly by experiment. FIG. 4 shows the activity surface plots for BpGUS on fourteen different glucuronidated drug substrates tested across the indicated pH and temperature ranges. FIG. 5 shows the activity surface plots for EeGUS on fourteen different glucuronidated drug substrates tested across the indicated pH and temperature ranges.

Data from such activity surface plots then can be used to optimize enzyme blends for particular conditions, as described in detail in Example 5. Two different models for determining an optimal enzyme blend are provided. Either or both models can be used to determine an optimal enzyme blend for a particular set of enzymes to be included in a blend.

The first model (referred to herein as Model 1) for optimizing enzyme blends involves maximizing the sum of the blended activity. In this model, to determine the activity of a blend at a given pH ($pH_m$) and temperature ($T_n$), the fractional activities for all enzymes for a particular substrate are summed. For the case where these activities have been measured directly for a given enzyme, Equation 1a (below) describes how this is done. For the case where activities are adjusted based on either a model substrate, where it has been measured for the whole activity surface, or where the activity surface itself has been modeled mathematically from a single point, the summed activities are calculated with Equation 1b (below). The product of summed activities for all substrates, theta ($\theta$), is then calculated with Equation 2 (below). The $x^{th}$ root of theta is called the root sum activity. Using optimization software, the optimal blend for a particular pH and T is determined by maximizing theta, which represents the activity across all substrates at $pH_m$ and $T_n$. To determine the optimal blend for a wider pH and/or temperature range, the activity products for each point on the reaction surface are averaged and the fractional activities optimized by maximizing the average activity.

$$A_1, pH_m, T_n = (f_a \cdot A_a, pH_m, T_n) + (f_b \cdot A_b, pH_m, T_n) + \ldots + (f_z \cdot A_z, pH_m, T_n) \quad \text{Equation 1a}$$

$$A_1, pH_m, T_n = (f_a \cdot A_a \cdot \hat{A}_{a,PTGlcU}, pH_m, T_n) + (f_b \cdot A_b \cdot \hat{A}_{b,PTGlcU}, pH_m, T_n) + \ldots + (f_z \cdot A_z \cdot \hat{A}_{z,PTGlcU}, pH_m, T_n) \quad \text{Equation 1b}$$

$$\Theta pH_m, T_n = (A_1, pH_m, T_n) \cdot (A_2, pH_m, T_n) \cdot (A_3, pH_m, T_n) \ldots (A_x, pH_m, T_n) \quad \text{Equation 2}$$

Where:
A=activity, typically expressed in moles product per gram protein per unit time (for example: $pmol \cdot mg^{-1} \cdot min^{-1}$), for the enzyme, substrate, and/or condition indicated by the subscripts;

$\hat{A}$=normalized activity based on the indicated model substrate and/or activity surface model. For this example, PTGlcU is the model substrate. However, the ordinarily skilled artisan will appreciate that other model substrates can be used, and this example is not limited to PTGlcU and does not exclude the possibility of using other model substrates;

a, b, . . . z=different enzymes;

1, 2, . . . x=different substrates;

m and n denote particular pH and temperature, respectively;

f=fraction of the subscripted enzyme in a blend. $f_a + f_b + \ldots + f_z = 1$; $0 \leq f \leq 1$ for all f.

A blend may be further optimized for a contiguous range of pH and temperature by averaging theta across the range and adjusting the fractions to maximize the average.

Accordingly, in another aspect, the disclosure pertains to a method of preparing an enzyme blend that is optimized for a given temperature, pH, and substrate target range, wherein each enzyme within the blend has the same EC number and wherein the specific activity of each enzyme on each substrate for the given temperature and pH is known, the method comprising:

(i) calculating the fractional activity of each enzyme based on the fraction of enzyme in the blend multiplied by the specific activity of the enzyme under the given conditions of temperature and pH;
(ii) summing the fractional activities for all enzymes for each substrate;
(iii) multiplying the total activities at the given temperature and pH for each substrate in the target range;
(iv) maximizing the grand total activity at the given temperature and pH by adjusting the fractions of enzyme in the blend, to thereby obtain an optimized fraction for each enzyme in the blend; and
(v) combining the optimized fraction of each enzyme together to thereby prepare the enzyme blend.

Steps (i) and (ii) above can be performed, for example, using Equation 1a or Equation 1b set forth above.

Step (iii) above can be performed, for example, using Equation 2 set forth above.

In one embodiment, the enzyme blend is further optimized for a broader temperature and pH range by summing the grand totals from each temperature and pH condition and adjusting the enzyme fractions to maximize the summed grand totals. In one embodiment, the grand total activities are weighted in proportion to the probability that samples to undergo enzymatic hydrolysis will represent a particular temperature and pH condition.

The second model (referred to herein as Model 2) for optimizing enzyme blends utilizes the minimal enzyme amounts required for complete hydrolysis at specified conditions (pH and temperature for a defined length of time) and thus is also referred to as a minimal enzyme requirement model. In this model, to determine an amount of enzyme blend and a blend ratio to completely hydrolyze all fourteen substrates at a given pH ($pH_m$) and temperature ($T_n$), the total amount of blended enzyme to achieve a complete hydrolysis of each substrate at a given blend ratio and at a given time (t) is solved using Equation 3. To determine the optimal blend for minimal enzyme amount requirement at a given pH and temperature, the blend ratio is solved by minimizing the total amount of blended enzyme required to complete hydrolysis for all fourteen substrates within a given incubation time.

$$\lambda_1 pH_m, T_n = \left( \frac{pmol_1}{((f_a \cdot A_a, pH_m, T_n) + (f_b \cdot A_b, pH_m, T_n) + \ldots + (f_z \cdot A_z, pH_m, T_n)) \cdot t} \right) \quad \text{Equation 3}$$

Where:
λ=total amount of blended enzyme expressed in milligrams;
pmol=total amount of substrate expressed in picomoles;
a, b, . . . z=different enzymes;
1, 2, . . . x=different substrates; m and n denote particular pH and temperature, respectively;
f=fraction of the subscripted enzyme in a blend. $f_a + f_b + \ldots + f_z = 1$; $0 \le f \le 1$ for all f;

t=incubation time desired to complete hydrolysis expressed in minutes.

In one embodiment, each enzyme within the blend has the same Enzyme Commission (EC) number. In one embodiment, each enzyme in the blend is a beta-glucuronidase enzyme (EC number 3.2.1.31). In one embodiment, each enzyme in the blend is a sulfatase (EC number 3.1.6.1).

Once the components of an enzyme blend are optimized (i.e., the fraction of each enzyme to be included in the blend, for a desired range of substrates using a desired set of conditions, such as pH and temperature ranges) as described above, the enzyme blend is prepared simply by combining the enzymes (i.e., at least two or more enzymes) together in the appropriate amounts (i.e., appropriate fractions, expressed for example as % of the total protein mass and/or the % of the total enzyme mass for each enzyme to be included in the blend). Accordingly, in another aspect, the disclosure pertains to a method of preparing an enzyme blend, the method comprising combining at least two enzymes together, wherein the ratio (i.e., fraction) of each enzyme in the blend is optimized such that the blend exhibits enhanced properties as compared to each enzyme alone (e.g., synergistic properties, such as any of those described herein). The ratio (i.e., fraction) of each enzyme in the blend can be determined according to any of the methodologies described herein for optimizing the enzyme blend (e.g., Model 1 or Model 2, described herein). Additional excipients can be added to the enzyme blend to prepare a formulation of the disclosure, as described further in subsection IV above. Furthermore, the enzyme blend composition or formulation can be prepared as an aqueous solution or a lyophilized preparation, as described in subsection IV above.

The present invention is further illustrated by the following examples, which should not be construed as further limiting. The contents of Sequence Listing, figures and all references, patents and published patent applications cited throughout this application are expressly incorporated herein by reference.

EXAMPLES

Example 1: Gene Synthesis, Cloning and Protein Expression

In this example, genes for various beta-glucuronidase enzymes were synthesized cloned and expressed. The DNA sequence coding for a protein sequence can be reconstructed from the protein sequence by standard methods well known in the art using the genetic code. For example, amino acid sequences for BGUS enzymes from *Aspergillus oryzae* (AoGUS), *Aspergillus terreus* (AtGUS), *Bacteriodes fragilis* (BfGUS), *Bacteroides uniformis* (BuGUS), *Brachyspira murdochii* (BmGUS), *Brachyspira pilosicoli* (BpGUS), *Clostridium perfringens* (CpGUS), *Escherichia coli* (EcGUS), IMCSzyme® variant *Escherichia coli* K12 (EcE1F), *Eubacterium eligens* (EeGUS), *Homo sapiens* (HsGUS), *Lactobacillus brevis* (LbLR2D), *Mus musculus* (MmGUS), *Parabacteroides* sp. (PmGUS), *Staphylococcus* sp. (StpGUS) and *Streptococcus agalactiae* (SaGUS) are shown in SEQ ID Nos: 1-16, respectively, and can be used to design appropriate DNA sequences coding for the enzymes. Additionally, FIG. 1 shows the amino acid sequence alignment for these sixteen BGUS enzymes that are shown in SEQ ID Nos: 1-16.

Typically, the enzyme-encoding DNA sequence is synthesized with consideration for the codon bias of the expression host, an approach also well established in the art. Using such methods, genes for EcE1F, AoLi-3, AtLi-20, BpGUS and EeGUS were synthesized with a codon bias compatible for expression in *Escherichia coli* host cells. The genes were cloned into plasmid vectors, placed under the control of an inducible promoter and expressed in a bacterial strain supportive of the construct, all using standard recombinant DNA technology. Enzymes were expressed intracellularly, the cells were lysed by a combination of physical and chemical means, and the lysates clarified by centrifugation. The lysates were then adjusted with buffer compatible with subsequent purification steps.

Example 2: Protein Purification and Acquisition

In this example, the cloned BGUS enzymes from Example 1 were further purified. Recombinant enzymes were purified by standard chromatography techniques known to those skilled in the art, on an AKTA™ Pure FPLC. Protein elution was monitored by measuring the absorbance at 280 nm, and protein purity was analyzed by standard SDS-PAGE and protein concentration was determined with the Bradford protein assay. The SDS-PAGE analysis revealed purified protein bands of the expected molecular weight for the BGUS enzymes applied to the gel, demonstrating effective purification of the recombinant enzymes. A representative SDS-PAGE gel for purified recombinant BpGUS and EeGUS is shown in FIG. 2. BpGUS is shown in lane 1, EeGUS is shown in lane 2 and molecular weight markers (in kD) are shown in the lane marked M. Protein purity by gel quantification was calculated using ImageQuant IL 1D v8.1 software, which indicated 94% purity for BpGUS and 93% purity for EeGUS.

Example 3: Activity Measurements Using Phenolphthalein-β-D-Glucuronide

In this example, activity of a panel of recombinant BGUS enzymes was measured using the substrate phenolphthalein-β-D-glucuronide (PTGlcU), a standard substrate for monitoring and reporting BGUS activity, across a range of pH.

Figure 3:
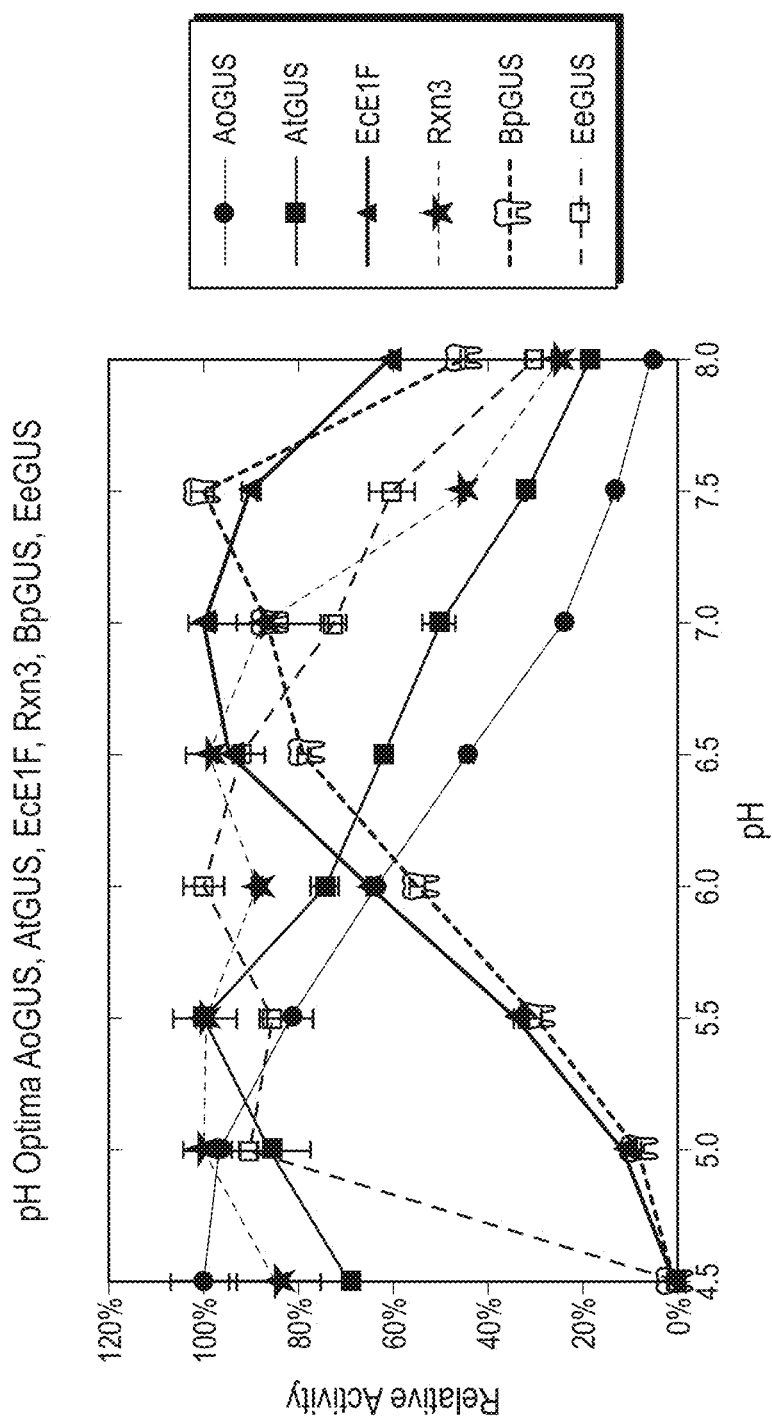
FIG. 3 is a graph showing the relative enzyme activity of recombinant EcE1F, BpGUS, EeGUS, AoLi-3 and AtLi-20 BGUS enzymes across a range of pH.

The pH profile for each recombinant enzyme was determined using a buffer system described in the art (Ellis and Morrison (1982) *Methods Enzymol.* 87:405-426), with phenolphthalein-β-D-glucuronide as the substrate. All enzymes were used at the same protein concentration with 1.0 mM PTGlcU in 10% ethanol. For set up, 25 µL of enzyme and 25 µL PTGlcU were mixed in a 96-well place format at room temperature and the reactions were stopped after 10 minutes by addition of 150 µL 0.2 M glycine, pH 10.4. The buffer pH range tested was from pH 4.5-8.0. Thirty minutes after stopping the reaction, the absorbance of each well was read at 540 nm. The pH profiles of each recombinant enzyme (BpGUS, EeGUS, EcE1F, AoGUS and AtGUS) are shown in FIG. 3.

In summary, each enzyme had 80% or greater activity in the optimum pH ranges shown below in Table 1:

TABLE 1 pH Optimum Ranges for Recombinant BGUS Enzymes

| BGUS Enzyme | Optimum pH Range |
| --- | --- |
| BpGUS | pH 7.0-7.5 |
| EeGUS | pH 5.0-6.5 |
| EcE1F | pH 6.5-7.5 |
| AoGUS | pH 4.5-5.5 |

TABLE 1-continued pH Optimum Ranges for Recombinant BGUS Enzymes

| BGUS Enzyme | Optimum pH Range |
| --- | --- |
| AtGUS | pH 5.0-5.5 |
| Rxn3 | pH 4.5-7.0 |

Example 4: Activity Surfaces with a Panel of Multiple Drug-Glucuronides

In this example, activity surface plots were prepared for beta-glucuronidases using a panel of substrates, determining activity across a range of pH and temperatures.

Each recombinant beta-glucuronidase was used to deconjugate fourteen glucuronidated drugs frequently tested in urine drug-testing applications. The substrates represent a wide variety of drug classes, such as opiates, synthetic opioids, benzodiazepines, and anti-depressants. The substrates included morphine-3-β-D-glucuronide (M3G), oxymorphone-3-β-D-glucuronide (OM3G), hydromorphone-3-β-D-glucuronide (HM3G), codeine-6-β-D-glucuronide (C6G), dihydrocodeine-6-β-D-glucuronide (DHC6G), buprenorphine-3-β-D-glucuronide (BUP gluc), norbuprenorphine-3-β-D-glucuronide (NBUP gluc), tapentadol glucuronide (TAP gluc), O-desmethyltramadol glucuronide (ODT gluc), O-desmethylvenlafaxine glucuronide (ODV gluc), amitriptyline-N-β-D-glucuronide (AMT gluc), oxazepem glucuronide (OXZ gluc), lorazepam glucuronide (LOR gluc) and temazepam glucuronide (TEM gluc). The substrates were fortified in synthetic urine at a concentration equivalent to 500 ng/mL when liberated.

The hydrolysis buffer used was 0.2 M sodium acetate, pH ranged from 4.0 to 7.0 with 0.5 increments. The internal standard solution was prepared at 1 µg/mL of each deuterated drug standard in methanol. 50 µL of urine containing the fourteen substrates was mixed with 150 µL of hydrolysis buffer, 20 µL enzyme solution (five different dilutions) and 10 µL internal standard solution. The incubations were performed at 20° C., 25° C., 30° C., 35° C. or 40° C. for 15 minutes. Samples were extracted using dispersive pipette extraction tips with WAX/RP resins as described in the art. Samples were eluted twice, each in 200 µL of acetonitrile with 1% formic acid. Prior to LC-MS/MS analysis, samples were dried down to 100 µL and diluted with 700 µL of water.

Ultra-performance liquid chromatography was performed on a Thermo-Scientific™ Vanquish™ UHPLC system using a Phenomenex Kinetex® Phenyl-Hexyl 100 Å column (4.6× 50 mm, 2.6 µm). The column was heated to 40° C. with a gradient elution with a flow rate of 0.6 mL/min. Mobile phase A consisted of 0.1% formic acid in ultrapure water and mobile phase B consisted of 0.1% formic acid in acetonitrile. The system was equilibrated in 95% A for the first 0.5 minutes and the gradient consisted of 5-95% B from 0.5-3.0 minutes and re-equilibrated at initial conditions from 4.0-6.0 minutes. The liquid chromatography (LC) system was connected to a Thermo-Scientific™ Endura™ Triple Quadrupole mass spectrometer with an electrospray ionization source, operated in positive mode. Detection was performed by multiple reaction monitoring (MRM) analysis of the most intense transitions originating from the protonated molecular ion [M+1] of each analyte. The aglycone species was quantified and enzyme activity was expressed as $pmol \cdot min^{-1} \cdot mg^{-1}$.

Based on the enzyme activity results across the pH and temperature ranges, activity surface plots were prepared.

FIG. 4 shows the activity surface plots for BpGUS on the fourteen different glucuronidated drug substrates tested across the indicated pH and temperature ranges. FIG. 5 shows the activity surface plots for EeGUS on the fourteen different glucuronidated drug substrates tested across the indicated pH and temperature ranges. FIG. 6 shows the activity surface plots for the chimeric BGUS enzyme Rxn3 (which has the amino acid sequence shown in SEQ ID NO: 19) on the fourteen different glucuronidated drug substrates tested across the indicated pH and temperature ranges. The data from these activity surface plots can be used to optimize enzyme blends for particular conditions, as described further in Example 5.

Example 5: Optimizing an Enzyme Blend for a Particular Condition

In this example, two approaches are described for optimizing an enzyme blend for a particular set of conditions, such as pH and temperature.

The pH and temperature profiles for each enzyme under consideration for inclusion in the blend must be determined (e.g., as described in Examples 3 and 4) or reasonably predicted, and then combined to create an activity surface (as described in Example 4 and shown in FIGS. 4 and 5). There are two ways this can be done. First, except for amplitude, activity profiles are often more dependent upon the enzyme than any particular substrate. Therefore, in theory any substrate may be used to determine the shape of the activity surface for an enzyme, and it may not be necessary to measure the entire activity surface for every substrate; once the shape is determined, it may be multiplied by the relative amplitude of each individual substrate to determine the activity surface for that substrate. Thus, one substrate can be used to determine the topology of the pH versus temperature (T) activity landscape, preferably an easily assayed substrate such as phenolphthalein-β-D-glucuronide. Secondly, however, if possible, measuring the activity surface for each individual enzyme with every target substrate of interest is preferred and can be determined using the methodology described in Example 4.

Furthermore, if desired or necessary, both temperature and pH profiles can be mathematically modeled using formulae known in the art. For example, enzyme activity increases exponentially with increasing temperature (the Qio law, or temperature coefficient), up until it reaches the temperature at which the rate of denaturation overwhelms the catalytic rate. Similarly, the pH profile can be modeled using titration curves that reflect the $pK_a$s of the two active-site residues (McIntosh et al. (1996) *Biochemistry* 35:9958; Joshi et al. (2001) *Biochemistry* 40:10115). An activity surface based either on comprehensive measurements for a model substrate (such as PTGlcU) or a surface based on modeling is normalized by dividing all activities by the activity at the optimal pH and preferred temperature.

The activity of each individual enzyme against a panel of substrates is determined at the enzyme's optimal pH and the preferred assay temperature. Multiplying these values over the pH and temperature profiles (either actual or modeled) creates activity surfaces for each enzyme-substrate pair.

The first model (referred to herein as Model 1) for optimizing enzyme blends involves maximizing the sum of the blended activity. In this model, to determine the activity of a blend at a given pH ($pH_m$) and temperature ($T_n$), the fractional activities for all enzymes for a particular substrate are summed. For the case where these activities have been measured directly for a given enzyme, Equation 1a (below) describes how this is done. For the case where activities are adjusted based on either a model substrate, where it has been measured for the whole activity surface, or where the activity surface itself has been modeled mathematically from a single point, the summed activities are calculated with Equation 1b (below). The product of summed activities for all substrates, theta (θ), is then calculated with Equation 2 (below). The $x^{th}$ root of theta is called the root sum activity. Using optimization software, the optimal blend for a particular pH and T is determined by maximizing theta, which represents the activity across all substrates at $pH_m$ and $T_n$. To determine the optimal blend for a wider pH and/or temperature range, the activity products for each point on the reaction surface are averaged and the fractional activities optimized by maximizing the average activity.

$$A_{1,}pH_m,T_n = (f_a \cdot A_a, pH_m, T_n) + (f_b \cdot A_b, pH_m, T_n) + \ldots + (f_z \cdot A_z, pH_m, T_n) \qquad \text{Equation 1a}$$

$$A_{1,}pH_m,T_n = (f_a \cdot A_a \cdot \hat{A}_{a,PTGlcU}, pH_m, T_n) + (f_b \cdot A_b \cdot \hat{A}_{b,PTGlcU}, pH_m, T_n) + \ldots + (f_z \cdot A_z \cdot \hat{A}_{z,PTGlcU}, pH_m, T_n) \qquad \text{Equation 1b}$$

$$\Theta pH_m, T_n = (A_{1,}pH_m, T_n) \cdot (A_{2,}pH_m, T_n) \cdot (A_{3,}pH_m, T_n) \ldots (A_{x,}pH_m, T_n) \qquad \text{Equation 2}$$

Where:
A=activity, typically expressed in moles product per gram protein per unit time (for example: $pmol \cdot mg^{-1} \cdot min^{-1}$), for the enzyme, substrate, and/or condition indicated by the subscripts;

$\hat{A}$=normalized activity based on the indicated model substrate and/or activity surface model. For this example, PTGlcU is the model substrate. However, the ordinarily skilled artisan will appreciate that other model substrates can be used, and this example is not limited to PTGlcU and does not exclude the possibility of using other model substrates;

a, b, . . . z=different enzymes;

1, 2, . . . x=different substrates;

m and n denote particular pH and temperature, respectively;

f=fraction of the subscripted enzyme in a blend. $f_a + f_b + \ldots + f_z = 1$; $0 \leq f \leq 1$ for all f.

A blend may be further optimized for a contiguous range of pH and temperature by averaging theta across the range and adjusting the fractions to maximize the average.

The second model (referred to herein as Model 2) for optimizing enzyme blends utilizes the minimal enzyme amounts required for complete hydrolysis at specified conditions (pH and temperature for a defined length of time) and thus is also referred to as a minimal enzyme requirement model. In this model, to determine an amount of enzyme blend and a blend ratio to completely hydrolyze all fourteen substrates at a given pH ($pH_m$) and temperature ($T_a$), the total amount of blended enzyme to achieve a complete hydrolysis of each substrate at a given blend ratio and at a given time (t) is solved using Equation 3. To determine the optimal blend for minimal enzyme amount requirement at a given pH and temperature, the blend ratio is solved by minimizing the total amount of blended enzyme required to complete hydrolysis for all fourteen substrates within a given incubation time.

$$\lambda_1 pH_m, T_n = \left( \frac{pmol_1}{((f_a \cdot A_a, pH_m, T_n) + (f_b \cdot A_b, pH_m, T_n) + \ldots + (f_z \cdot A_z, pH_m, T_n)) \cdot t} \right) \qquad \text{Equation 3}$$

Where:
λ=total amount of blended enzyme expressed in milligrams;
pmol=total amount of substrate expressed in picomoles;
a, b, . . . z=different enzymes;
1, 2, . . . x=different substrates; m and n denote particular pH and temperature, respectively;
f=fraction of the subscripted enzyme in a blend. $f_a+f_b+ \ldots +f_z=1$; $0 \leq f \leq 1$ for all f; t=incubation time desired to complete hydrolysis expressed in minutes.

Example 6: Enzyme Blends Exhibit Synergistic Activity

In this example, the optimization approach described in Example 5 was used to determine optimized blends of BpGUS and EeGUS (referred to herein as BpGUS/EeGUS) and of EeGUS and the chimeric enzyme Rxn3 (referred to herein as EeGUS/Rxn3) for optimized activity against the fourteen substrates described in Example 4. The blends were then tested experimentally and shown to have not merely additive activity against the substrates, but rather exhibited synergistic activity against the substrates.

For the BpGUS/EeGUS blend, first the surface activity profiles described in Example 4, and shown in FIGS. 4 and 5 for BpGUS and EeGUS, respectively, were applied to the maximizing sum of blended activity (Model 1) optimization approach described in Example 5. This provided a theoretical expected summed activity level for preparations containing 100% BpGUS, 86%/14% BpGUS/EeGUS, 75%/25% BpGUS/EeGUS, 50%/50% BpGUS/EeGUS, 25%/75% BpBUS/EeGUS and 100% EeGUS.

Blends of BpGUS and EeGUS containing the above-listed fractions of each enzyme were then prepared and their enzymatic activity against the fourteen substrates described in Example 4 was tested experimentally at pH 5.5 and 20° C. Each beta-glucuronidase blended formulation was used to deconjugate fourteen glucuronidated drugs frequently tested in urine drug testing applications. The substrates represent a wide variety of drug classes, such as opiates, synthetic opioids, benzodiazepines, and anti-depressants. The substrates included morphine-3-β-D-glucuronide, oxymorphone-3-β-D-glucuronide, hydromorphone-3-β-D-glucuronide, codeine-6-β-D-glucuronide, dihydrocodeine-6-β-D-glucuronide, buprenorphine-3-β-D-glucuronide, norbuprenorphine-3-β-D-glucuronide, tapentadol glucuronide, O-desmethyltramadol glucuronide, O-desmethylvenlafaxine glucuronide, amitriptyline-N-β-D-glucuronide, lorazepam glucuronide, oxazepam glucuronide and temazepam glucuronide. The substrates were fortified in synthetic urine at a concentration equivalent to 500 ng/mL when liberated.

Blended formulations were prepared from 2 or more β-glucuronidase solutions at 2 mg/mL, combined in different v/v percentages. The hydrolysis buffer used was 0.2 M sodium acetate, pH 5.5. The internal standard solution was prepared at 1 μg/mL of each deuterated drug standard in methanol. 50 μL of urine containing the fourteen substrates was mixed with 150 μL of hydrolysis buffer, 20 μL enzyme blend solution (five different dilutions) and 10 μL internal standard solution. The incubation was performed at 20° C. for 15 minutes. Samples were extracted using dispersive pipette extraction tips with WAX/RP resins as described in the art. Samples were eluted twice, each in 200 μL of acetonitrile with 1% formic acid. Prior to LC-MS/MS analysis, samples were dried down to 100 μL and diluted with 700 μL water.

Figure 7:
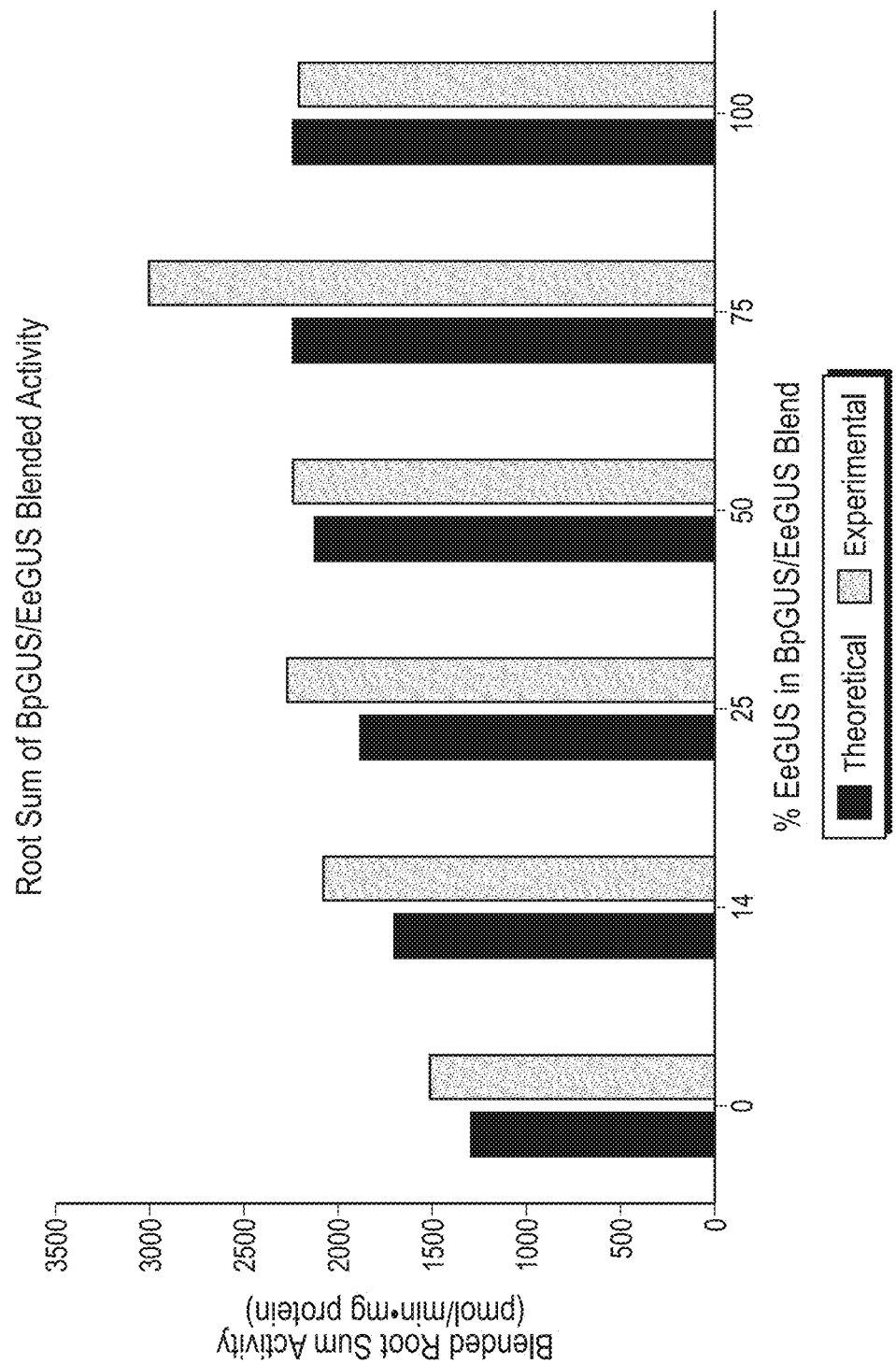
FIG. 7 is a bar graph showing the blended root sum activity (in pmol/min·mg protein) against fourteen substrates for blends of BpGUS and EeGUS blended at the indicated percentages. Dark grey bars show the theoretical expected activity of the blends and light grey bars show the actual experimental activity of the blends.

The same LC-MS/MS methodology described in Example 4 was used. The aglycone species was quantified and enzyme activity was expressed as pmol·min$^{-1}$·mg$^{-1}$ The blended root sum activity (the $x^{th}$ root of theta; pmol/min·mg protein) for each BpGUS/EeGUS blend was determined for the experimental results and compared to the theoretical expected values. This comparison is shown in the bar graph of FIG. 7. These results demonstrated that the experimentally-determined levels of blended root sum activity were actually higher than the theoretical expected values (which were based on an additive effect), thereby demonstrating that the enzyme blends were exhibiting synergistic activity against the substrates, not merely an additive effect. In particular, the optimized blend containing 25%/75% BpGUS/EeGUS exhibited significantly higher experimentally-determined blended root sum activity than the theoretical expected values, thereby demonstrating synergistic activity of BpGUS and EeGUS against the fourteen tested substrates when blended together at the indicated fractions.

Similarly, for the EeGUS/Rxn3 blend, first the surface activity profiles described in Example 4, and shown in FIGS. 5 and 6 for EeGUS and Rxn3, respectively, were applied to the maximizing sum of blended activity (Model 1) optimization approach described in Example 5. This provided a theoretical expected summed activity level for preparations containing 100% EeGUS, 70%/30% EeGUS/Rxn3, 50%/50% EeGUS/Rxn3, 30%/70% EeGUS/Rxn3 and 100% Rxn3.

Figure 8A:
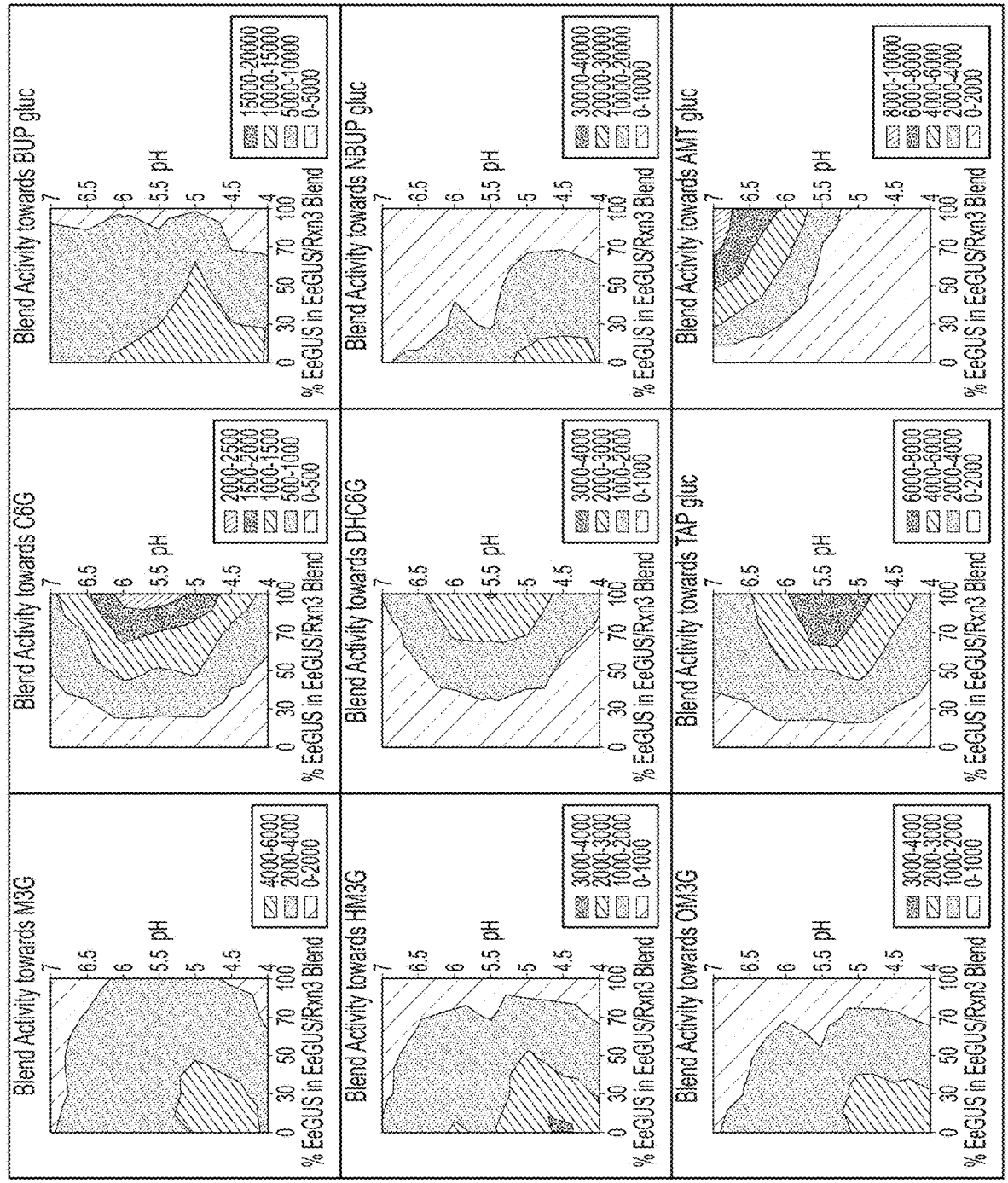
FIGS. 8A-8B are a series of graphs showing the activity surface plots for an enzyme blend of EeGUS and Rxn3 on fourteen different glucuronidated drug substrates across the indicated enzyme ratios and pH ranges.
Figure 8B:
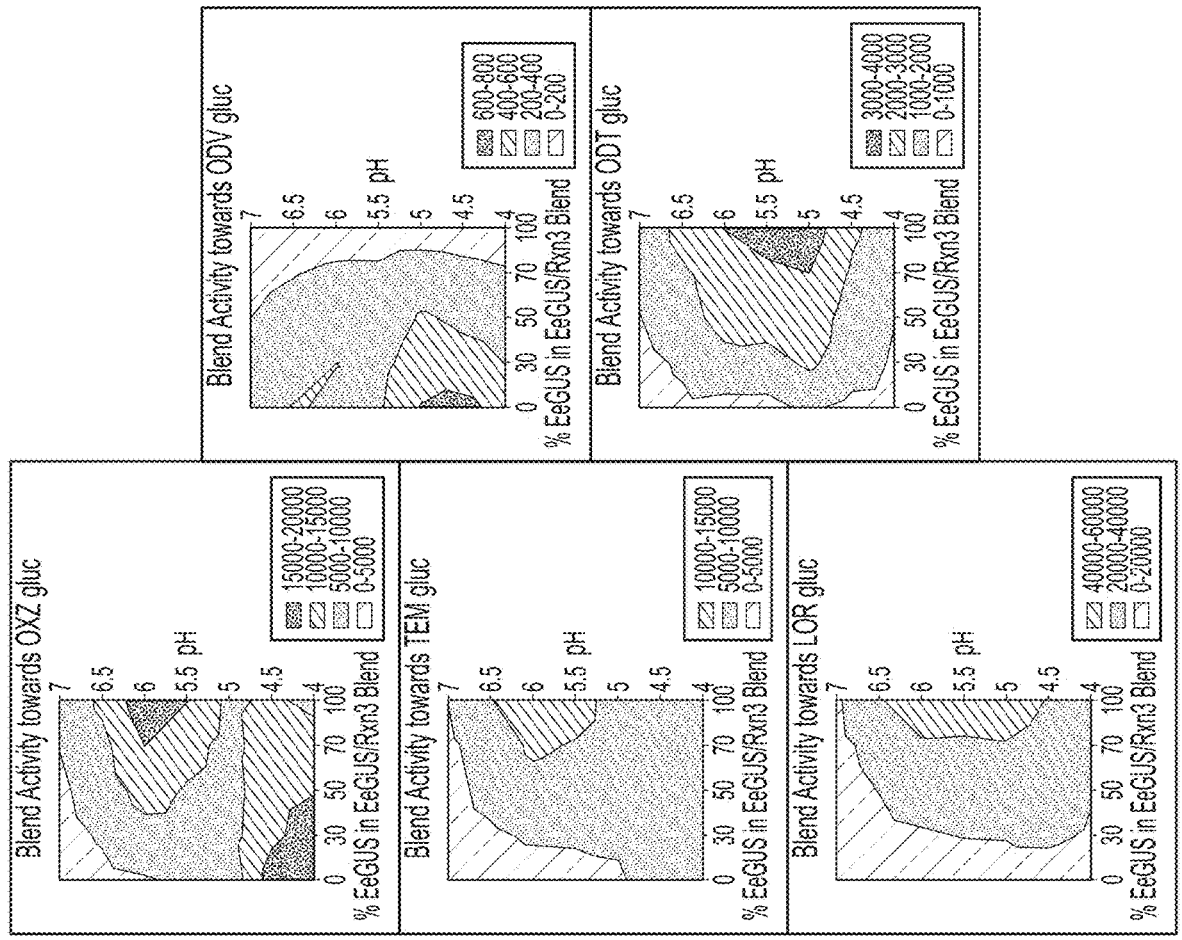

Blends of EeGUS and Rxn3 containing the above-listed fractions of each enzyme were then prepared and their enzymatic activity against the fourteen substrates described in Example 4 was tested experimentally at 20° C. over pH ranging from 4.0 to 7.0, as described above for the BpGUS/EeGUS blends. Surface activity profiles (determined as described in Example 4) for the EeGUS/Rxn3 blends against the fourteen substrates at 20° C. over pH 4.0-7.0 as a function of the percentage of EeGUS in the EeGUS/Rxn3 blend are shown in FIG. 8.

Figure 9:
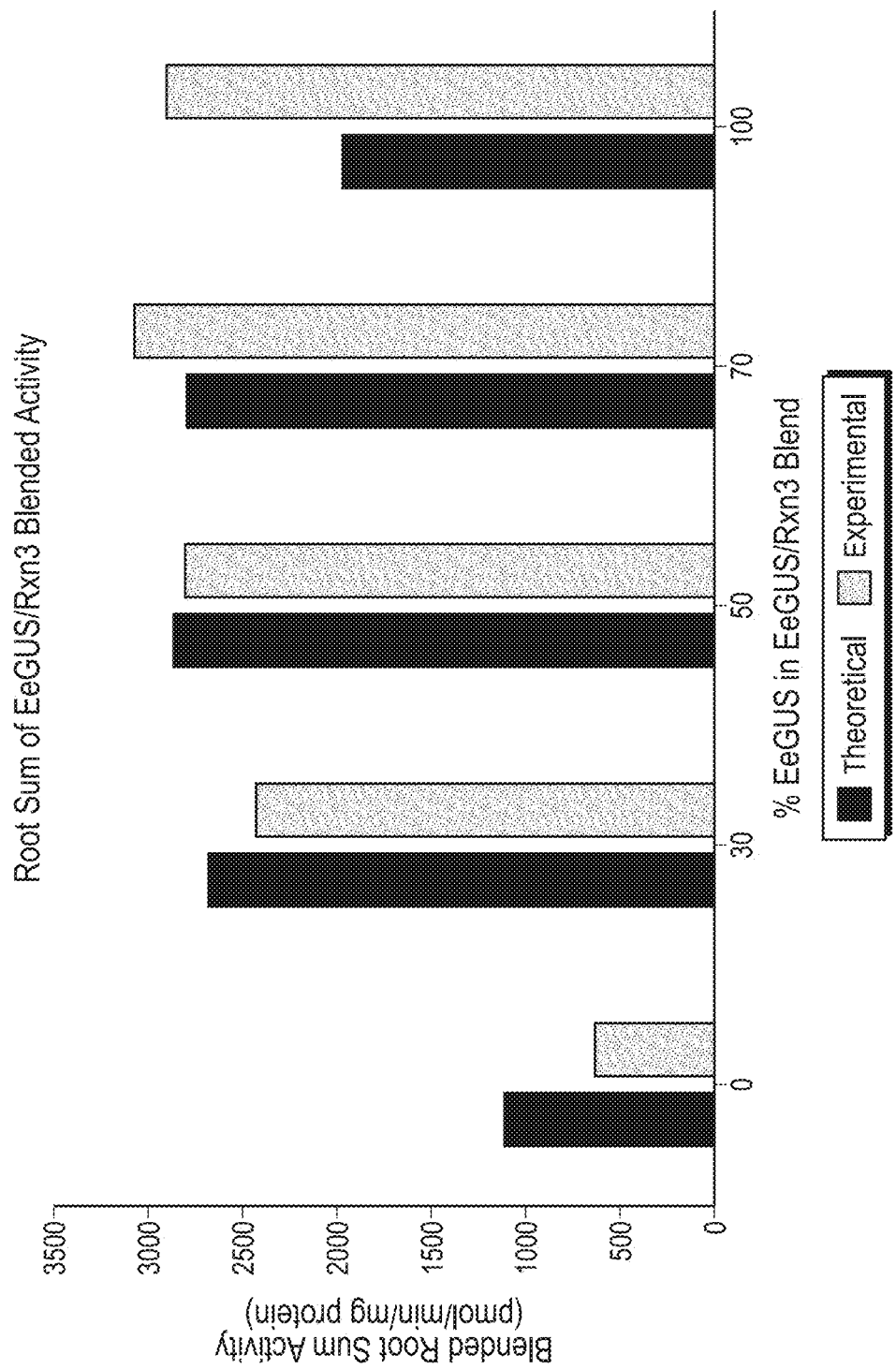
FIG. 9 is a bar graph showing the blended root sum activity (in pmol/min·mg protein) against fourteen substrates for blends of EeGUS and Rxn3 blended at the indicated percentages. Dark grey bars show the theoretical expected activity of the blends and light grey bars show the actual experimental activity of the blends.

The blended root sum activity (the $x^{th}$ root of theta; pmol/min·mg protein) for each EeGUS/Rxn3 blend was determined for the experimental results and compared to the theoretical expected values. This comparison is shown in the bar graph of FIG. 9. These results demonstrated that the experimentally-determined levels of blended root sum activity were actually higher than the theoretical expected values (which were based on an additive effect) for certain blend percentages, thereby demonstrating that the enzyme blends were exhibiting synergistic activity against the substrates, not merely an additive effect. In particular, the optimized blend containing 70%/30% EeGUS/Rxn3 exhibited higher experimentally-determined blended root sum activity than the theoretical expected values, thereby demonstrating synergistic activity of EeGUS and Rxn3 against the fourteen tested substrates when blended together at the indicated fractions.

Example 7: Comparison of Blend Optimization Approaches

In this example, the two optimization approaches described in Example 5, referred to as Model 1 and Model 2, were compared for BpGUS/EeGUS and EeGUS/Rxn3 blends.

Figure 10A:
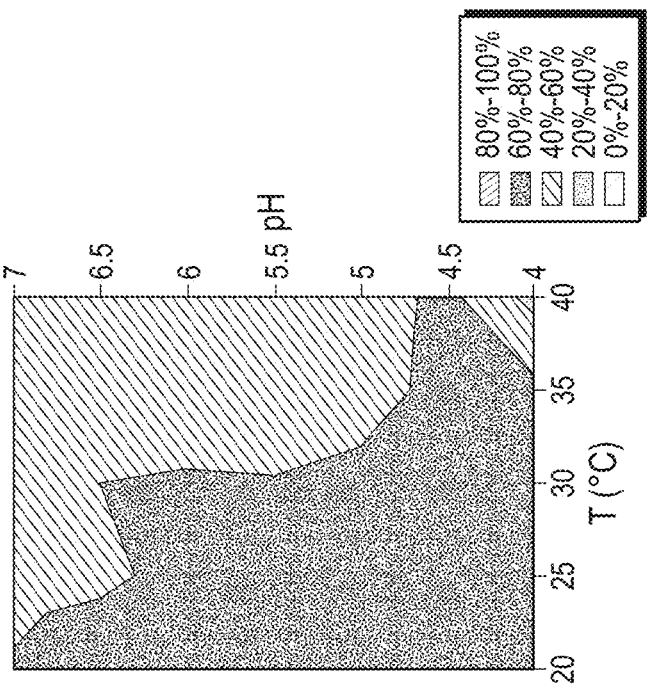
FIGS. 10A-10B are surface plots showing the percentage of BpGUS in BpGUS/EeGUS blends at the indicated pHs and temperatures needed to achieve maximal sum of blended activity (Model 1) (FIG. 10A) or needed to achieve the minimal enzyme amount required for 15 minute complete hydrolysis (Model 2) (FIG. 10B).
Figure 10B:
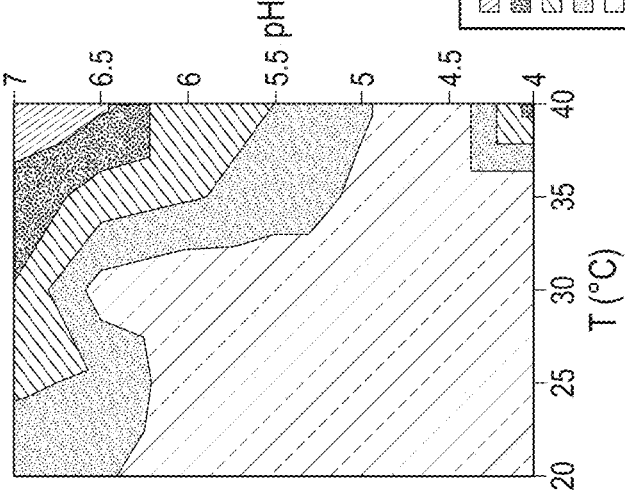

For the BpGUS/EeGUS blends, the percentage of BpGUS in the blend needed to achieve maximal root sum activity (calculated by Model 1) is shown in FIG. 10A across range of temperatures (20° C. to 40° C.) and a range of pHs (pH 4 to 7). The percentage of BpGUS in the blend needed to achieve the minimal enzyme amount required for complete hydrolysis for a 15 minute incubation (calculated by Model 2) is shown in FIG. 10B across range of temperatures (20° C. to 40° C.) and a range of pHs (pH 4 to 7).

Figure 11A:
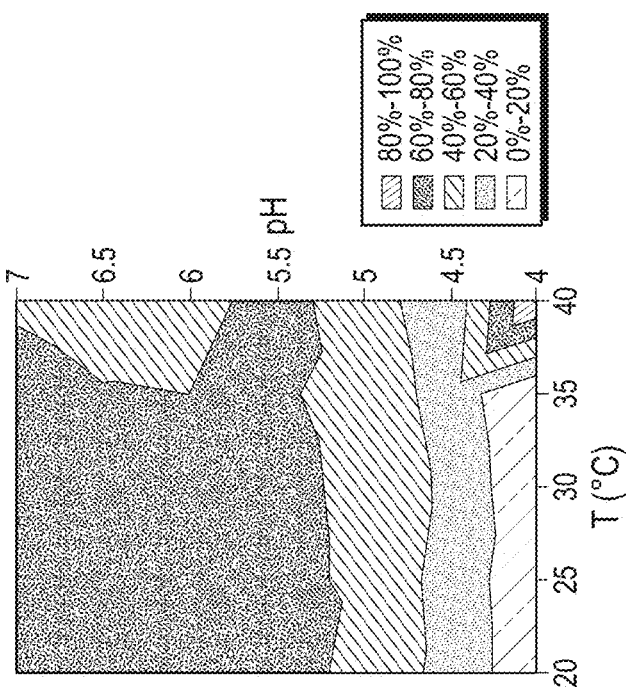
FIGS. 11A-11B are surface plots showing the percentage of Rxn3 in EeGUS/Rxn3 blends at the indicated pHs and temperatures needed to achieve maximal sum of blended activity (Model 1) (FIG. 11A) or needed to achieve the minimal enzyme amount required for 15 minute complete hydrolysis (Model 2) (FIG. 11B).
Figure 11B:
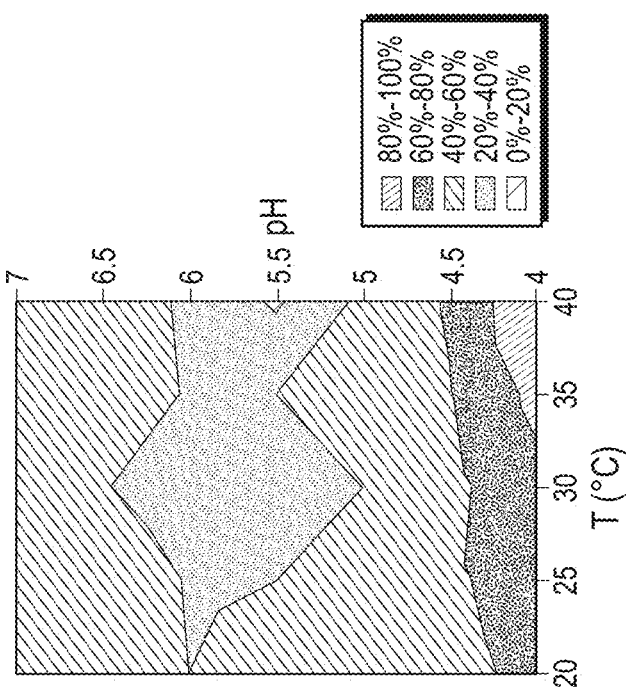

For the EeGUS/Rxn3 blends, the percentage of Rxn3 in the blend needed to achieve maximal root sum activity (calculated by Model 1) is shown in FIG. 11A across range of temperatures (20° C. to 40° C.) and a range of pHs (pH 4 to 7). The percentage of Rxn3 in the blend needed to achieve the minimal enzyme amount required for complete hydrolysis for a 15 minute incubation (calculated by Model 2) is shown in FIG. 11B across range of temperatures (20° C. to 40° C.) and a range of pHs (pH 4 to 7).

EQUIVALENTS

Those skilled in the art will recognize or be able to ascertain using no more than routine experimentation, many equivalents of the specific embodiments of the invention described herein. Such equivalents are intended to be encompassed by the following claims.

SUMMARY OF SEQUENCE LISTING

| SEQ ID NO: | DESCRIPTION |
|---|---|
| 1 | MLKPQQTTTRDLISLDGLWKFALASDDNNTQPWTSQLKTSLECPVPASYNDIFADSK IHDHVGWVYYQRDVIVPKGWSEERYLVRCEAATHHGRIYVNGNLVADHVGGYTPFE ADITDLVAAGEQFRLTIAVDNELTYQTIPPGKVEILEATGKKVQTYQHDFYNYAGLAR SVWLYSVPQQHIQDITVRTDVQGTTGLIDYNVVASTTQGTIQVAVIDEDGTTVATSSGS NGTIHIPSVHLWQPGAAYLYQLHASIIDSSKKTIDTYKLATGIRTVKVQGTQFLINDKP FYFTGFGKHEDTNIRGKGHDDAYMVHDFQLLHWMGANSFRTSHYPYAEEVMEYAD RQGIVVIDETPAVGLAFSIGAGAQTSNPPATFSPDRINNKTREAHAQAIRELIHRDKNH PSVVMWSIANEPASNEDGAREYFAPLPKLARQLDPTRPVTFANVGLATYKADRIADL FDVLCLNRYFGWYTQTAELDEAEAALEEELRGWTEKYDKPIVMTEYGADTVAGLHS VMVTPWSEEFQVEMLDMYHRVFDRFEAMAGEQVWNFADFQTAVGVSRVDGNKKG VFTRDRKPKAAAHLLRKRWTNLHNGTAEGSKTFQ (AoGUS: *Aspergillus oryzae* BGUS) |
| 2 | MLKPRQTPFRDLISLDGLWKFALDSGDNATAAPWTGPLTTDLECPVPASYNDIFVDR QIRDHVGWVYYQREAIVPRAWSQQQYLVRVDAATHQGRIYINDNLVAEHRGGYTPFE ADITGLVSAGDSFRLTIAVNNELTHETIPPGRIEVEEYTGKRVQVYQHDFFNYAGLARS VWLYSVPQQHIQDIKVVTHVKGSAGLINYLVTVSNSTTGRVKIDVIDKDGTTVAEASG ARGSVTIDSVKLWQPGEAYLYQFRASIVGLNDSVVDTYCVETGVRTVKVSGNRFLIND KPFYFTGFGKHEDSAVRGKGYDPAYMVHDFQLMDWMGANSFRTSHYPYAEEVMEF ADRHGIVVIDETPAVGLAFSIGSGVSSEDSPQTFTPEGINNNTREAHKQAIRELIARDK NHASVVMWSIANEPASQEVGAREYFAPLVDLAHELDPSRPVCFANYGDATYEVDRIS DMFDVLCLNRYFGWYSQTGEVEEAEAALEKELLGWEGKYGKPIVITEYGADTMAGLH SVLALPWSEEFQVQLLDMYHRVFDRIDSVVGEHVWNFADFQTAVGIIRVDGNKKGVF TRERKPKAAAHTLKTRWSGMLGSDH (AtGUS: *Aspergillus terreus* BGUS) |
| 3 | MKKLLAAAMLFMLNSWSCFSADTPRAEYPRPQFEREQWVNLNGTWTFDFDFGKSG KDRRLQSAEKFDKNITVPFCPESKLSGVGYTDFIEQMWYQRNITIPSDWNGKKIFLNF GAVDYCAEIYVDGKFVQRHFGGSSSFAVDLTRYVTPGKTHNLVVFVQDDLRSGLQTGG KQCGNYYSGGCSYTRTTGIWQTVWMEAVSADGLKSVFVRPDIDQKQLVIEPEFYNES ANTLEITLKDRNKTVAKKSVNCANSSVVVLPVKNMKLWSPEDPFLYDLVYQVKDAK GNVLDEVKSYAGMRKVHTANGRFYLNNQPYFQRLVLDQGFYPEGIWTAPSDEDLKN DIVLGKEAGFNGARLHQKVFEERYYYWADKLGYITWGESASWMLDVNKELAARNFL GEWSEVVVRDRNHPSLVTWTPFNETWGGGPDAYIRLVRDVYNITKAIDPTRPVNDA SGDNHVITDIWSVHNYEQDRAKLTEQLKMEEGKEPYRNARDKDFLAVYEGQPYMVD EFGGIPWMAEKDRKNSWGYGGMPENAEAFYKRLEGQIDAFIDSPHVTGFCYTQLTDV EQEKNGIYYYDRTPKLDMKRIKAIFEKIK (BfGUS: *Bacteroides fragilis* BGUS) |
| 4 | MKTLLKNSLTFLLMLMPVLAFAQQAPQIMNVSARQTTSLDGQWKTIVDPFENGYYD YRLKPYDGGYAQDKTYSDKTKLQEYDFETDKLLFVPGDWNTQRPQLYYYEGTVWYR KHFEYSLQPGKRLFLNFGAVNYEAIVWLNGKRLGRHIGGFTPFNFEITNLLKEGTNSL VVKVDNKRLPEAVPTVNADWNFGGITRPVTLIEMPATYIRDYYVQLAKDDKNMIE GWVQLEGSDKEQKITLDIPELKVKKEVTTDANGYASFLIKSKPILWTPENPKLYAVNL ASETDKVSDEIGFRTIRTEGIKILLNDKEIFCRGISIHEETPYYSGRAYSKDHAHTLLSW AKELGCNFVRLAHYPHNEEMVREAERMGFLVWSEIPVYWTIHWENKDTYQNAEQQ LCDMIARDKNRCNIIIWSIANETPHSETRLTFLSNLANKARSLDSVRLIGAAMEKEEVQ PGVLTVNDPLGELLDIISFNEYVGWYDGDSEKCDRVNWTFDTQKPVFISELGGGALYG RHGSPKERFTEEYQEDLYIRHVNMLKRIPGLAGTTPWILKDFRSPRRHVPEIQDDFNR KGLVSDKGQKKKAFFVLQKWYKELTEAYK (BuGUS: *Bacteroides uniformis* BGUS) |
| 5 | MVNSMLYPRESRTRRVVDISGMWEFKIDINNEGRNSGYANGLKDTTFIPVPSSFNDLF TDKNIREHAGDVWYETSFYLPLEWKDKDVNVRFGCATHEATVYINGKEVCTHVGGF MPFNAPVNEAGIFGEKNKLVVVVNNELSNTTIPCGHTETKPSGKKYIKPSFDFFNYAG LNRPVKITVTNKEYIHDIDILSDVNGSDGIVNYEVHTTGENKVYIKINDEEGKEVASCE GKSGKIVIKDAKLWNPKAAYLYKFIACIKNGDELIDEYYLDPGIRTVKVEGTKFLINGK PFYFTGFGKHEDSEIAGRGYNPPVIKRDFELIKWVGANSFRTSHYPYSEEIMQAADRE GIVIIDEVAAVGMFDVGSVLNPSASKTDYFSLDEVHSKTKEVHKKAVEELIKRDKNHP SVVMWSLFNEPDTSKDEAVPYFEDIFNFAKSQDKQNLPKTFAAIQASSPGKCKCMHL |

SUMMARY OF SEQUENCE LISTING

| SEQ ID NO: | DESCRIPTION |
|---|---|
| | CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpGUS: *Brachyspira pilosicoli* BGUS) |
| 6 | MVNSMLYPRESRTRRVVDISGMWEFKIDSNNEGRKNGYANGLKDTTFIPVPSSFNDL<br>FTDKNIREHAGDIWYETSFYLPLEWKDKNVNIRFGCATHEAAVYINGKEVCTHVGGF<br>MPFNAPVNEAGIFGEKNKLVVVVNNELSNTTLPCGHTETKPSGKKYIKPSFDFFNYAG<br>LNRPVKITVTNKEYIYDIDILSDINGSDGIVNYEVHTTGENKVFVKIYDEEGKEAASAEG<br>KNGKIVIKNAKLWNPKAAYLYKFEACIKNGEELIDEYYLDFGIRTIKVEGTKFLINGKP<br>FYFTGFGKHEDSETAGRGYNPPVIKRDFELIKWIGANSFRTSHYPYSEEIMQAADREGI<br>VIIDEIAAVGMFDVGSVLNPGASKADYFSLEEVHTKTKEIHKKAVEELITRDKNHPSVV<br>MWSLFNEPDTSKDEALPYFEDIFNFAKSIDKQNLPKTFAAIQASAPGKCKCMHLCDVI<br>TLNRYYGWYFLGGYEIDMSEEKFREEMNLYKDMNKPVMFTEYGADTYAGVHKLPSV<br>MWSEEYQCEYYEMNFKVFDSYDFIIGEQLWNFADFQTTEGIFRVDGNKKGIFTRTRQ<br>PKAVAHYIRSRWTKLPLDYKK<br>(BmGUS: *Brachyspira murdochii* BGUS) |
| 7 | MLYPIITESRQLIDLSGIWKFKLNEGNGLTEELSKAPLEDTIEMAVPSSYNDLVESQEV<br>RDHVGWVWYERNFTIPKTLLNERIVLRFGSATHEAKVYLNGELLVEHKGGFTPFEAE<br>INDLLVSGDNRLTVAVNNIIDETTLPVGLVKEVEVDGKKVIKNSVNFDFFNYAGIHRPV<br>KIYTTPKSYIEDITIVTDFKENNGYVNYEVQAVGKCNIKVTIIDEENNIVAEGEGKEGKL<br>TINNVHLWEPMNAYLYKLKVELLDDEEIIDTYFEEFGVRTVEVKDGKFLINNKPFYFK<br>GFGKHEDSYVNGRGINEAINIKDFNLMKWIGANSFRTSHYPYSEEIMRLADREGIVVID<br>ETPAVGLHLNFMATGFGGDAPKRDTWKEIGTKEAHERILRELVSRDKNHPCVVMWS<br>VANEPDSDSEGAKEYFEPLIKLTKELDPQKRPVTVVTYLMSTPDRCKVGDIVDVLCLN<br>RYYGWYVAGGDLEEAKRMLEDELKGWEERCPKTPIMFTEYGADTVAGLHDTVPVM<br>FTEEYQVEYYKANHEVMDKCKNFVGEQVWNFADFATSQGIIRVQGNKKGIFTRERKP<br>KMIAHSLRERWTNIPEFGYKK<br>(CpGUS: *Clostridium perfringens* BGUS) |
| 8 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDDFFNYAGI<br>HRSVMLYTTPNTWVDDITVVTHVAQDCNHASVDWQVVANGDVSVELRDADQQVVA<br>TGQGTSGTLQVVNPHLWQPGEGYLYELCVTAKSQTECDIYPLRVGIRSVAVKGEQFLI<br>NHKPFYFTGFGRHEDADLRGKGFDNVLMVHDHALMDWIGANSYRTSHYPYAEEML<br>DWADEHGIVVIDETAAVGFNLSLGIGFEAGNKPKELYSEEAVNGETQQAHLQAIKELI<br>ARDKNHPSVVMWSIANEPDTRPQGAREYFAPLAEATRKLDPTRPITCVNVMFCDAH<br>TDTISDLFDVLCLNRYYGWYVQSGDLETAEKVLEKELLAWQEKLHQPIIITEYGVDTL<br>AGLHSMYTDMWSEEYQCAWLDMYHRVFDRVSAVVGEQVWNFADFATSQGILRVGG<br>NKKGIFTRDRKPKSAAFLLQKRWTGMNFGEKPQQGGKQ<br>(EcGUS: *Escherichia coli* BGUS) |
| 9 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDDFFNYAGI<br>HRSVMLYTTPNTWVDDITVVTHVAQDCNHASVDWQVVANGDVSVELRDADQQVVA<br>TGQGTSGTLQVVNPHLWQPGEGYLYELCVTAKSQTECDIYPLRVGIRSVAVKGEQFLI<br>NHKPFYFTGFGRHEDADLRGKGFDNVLMVHDHALMDWIGANSYRTSHYPYAEEML<br>DWADEHGIVVIDETAAVGFNLSLGIGFEAGNKPKELYSEEAVNGETQQAHLQAIKELI<br>ARDKNHPSVVMWSIANEPDTRPQGAREYFAPLAEATRKLDPTRPITCVNVMFCDAH<br>TDTISDLFDVLCLNRYYGWYVQSGDLETAEKVLEKELLAWQEKLHQPIIITEYGVDTL<br>AGLHSMYTDMWSEEYQCAWLDMYHRVFDRVSAVVGEQVWNFADFATSQSILRVGG<br>NKKGIFTRDRKPKSAAFLLQKRWTGMNFGEKPQQGSKQGLCGR<br>(EcE1F: IMCSzyme® variant *Escherichia coli* K12 BGUS) |
| 10 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeGUS: *Eubacterium eligens* BGUS) |
| 11 | MARGSAVAWAALGPLLWGCALGLQGGMLYPQESPSRECKELDGLWSFRADFSDNRR<br>RGFEEQWYRRPLWESGPTVDMPVPSSFNDISQDWRLRHFVGWVWYEREVILPERW<br>TQDLRTRVVLRIGSAHSYAIVWVNGVDTLEHEGGYLPFEADISNLVQVGPLPSRLRITI |

| SEQ ID NO: | DESCRIPTION |
|---|---|
| | AINNTLTPTTLPPGTIQYLTDTSKYPKGYFVQNTYFDFFNYAGLQRSVLLYTTPTTYID DITVTTSVEQDSGLVNYQISVKGSNLFKLEVRLLDAENKVVANGTGTQGQLKVPGVSL WWPYLMHERPAYLYSLEVQLTAQTSLGPVSDFYTLPVGIRTVAVTKSQFLINGKPFYF HGVNKHEDADIRGKGFDWPLLVKDFNLLRWLGANAFRTSHYPYAEEVMQMCDRYG IVVIDECPGVGLALPQFFNNVSLHHHMQVMEEVRRDKNHPAVVMWSVANEPASHL ESAGYYLKMVIAHTKSLDPSRPVTFVSNSNYAADKGAPYVDVICLNSYYSWYHDYGHL ELIQLQLATQFENWYKKYQKPIIQSEYGAETIAGFHQDPPLMFTEEYQKSLLEQYHLG LDQKRRKYVVGELIWNFADFMTEQSPTRVLGNKKGIFTRQRQPKSAAFLLRERYWKI ANETRYPHSVAKSQCLENSLFT<br>(HsGUS: *Homo sapiens* BGUS) |
| 12 | MLYPMETASRVVLDLSGVWRFMIDKEQIPVDVTRPLPATLSMAVPASFNDQTASKEI REHVGYVWYERCFELPQLLRQERLVLRFGSATHEAWVYLNGHLITHHKGGFTPFEVE INDDLVTGENRLTVKLSNMLDYTTLPVGHYKETQNETGQRVRQLDENFDFFNYAGL QRPVKIYSTPHSYIRDITLTPKVNLTNHSAVVNGEIETVGDVEQVVVTILDEDNQVVGT TSGKTLAIELNSVHLWQPGKAYLYRAKVELYQAGQVIDTYIETFGIRQIAVKAGKFLIN GQPFYFKGFGKHEDAYIHGRGLSEPQNVLDLSLMKQMGANSFRTSHYPYSEEMMRLC DREGIVVIDEVPAVGLMLSFTFDVSALEKDDFEDDTWEKLRTAEAHRQAITEMIDRD KNHASVVMWSISNEAANFSKGAYEYFKPLFDLARKLDPQQRPCTYTSIMMTTLKTDR CLALADVIALNRYYGWYMGNGDLKAAETATREELLAYQAKFPDKPIMYTEYGADTIA GLHSNYDEPFSEEFQEDYYRMCSRVFDEVTNFVGEQLWNFADFQTKFGIQRVQGNKK GIFTRAREPKMVVRYLTQRWRNIPDFNYKK<br>(LbLR2D: *Lactobacillus brevis* BGUS) |
| 13 | MSLKWSACWVALGQLLCSCALALKGGMLFPKESPSRELKALDGLWHFRADLSNNRL QGFEQQWYRQPLRESGPVLDMPVPSSFNDITQEAALRDFIGWVWYEREAILPRRWT QDTDMRVVLRINSAHYYAVVWVNGIHVVEHEGGHLPFEADISKLVQSGPLTTCRITIA INNTLTPHTLPPGTIVYKTDTSMYPKGYFVQDTSFDFFNYAGLHRSVVLYTTPTTYID DITVITNVEQDIGLVTYWISVQGSEHFQLEVQLLDEGGKVVAHGTGNQGQLQVPSANL WWPYLMHEHPAYMYSLEVKVTTTESVTDYYTLPIGIRTVAVTKSKFLINGKPFYFQG VNKHEDSDIRGKGFDWPLLVKDFNLLRWLGANSFRTSHYPYSEEVLQLCDRYGIVVID ECPVGIVLPQSFGNESLRHHLEVMEELVRRDKNHPAVVMWSVANEPSSALKPAAYY FKTLITHTKALDLTRPVTFVSNAKYDADLGAPYVDVICVNSYFSWYHDYGHLEVIQPQ LNSQFENWYKTHQKPIIQSEYGADAIPGIHEDPPRMFSEEYQKAVLENYHSVLDQKRK EYVVGELIWNFADFMTNQSPLRVIGNKKGIFTRQRQPKTSAFILRERYWRIANETGGH GSGPRTQCFGSRPFTF<br>(*Mus musculus* BGUS) |
| 14 | MKRISIAFLSLFLCVASVWSMPRPEYPRPQFERAGWVNLNGEWTCSFDFGGSGMERE FYKSKGFDKKITVPFCPESKLSGIGYTDFINHFWYQRPITIPQEWNGKNILLNFGAVYY KSEVYIDGVLASRHFGGTSSFAVDITSLVKPGQTHSLVVYVESDVRGAKQAAGKQNLQ YASYGCNYTRTTGIWQTVWMEAVHPEGLQSIQLLTDIDQQQLVVRPRFYKEAGGKLQ VTLKDNGKVVASRTVSASSLSSVVLPVKKMKTWSPESPFLYDLEYKVLDKNGNIIDEV NGYAGMRKVHIEGNKIYLNNKPYYQRLVLDQGFYPDGIWTAPSDEALKRDIELSMEA GFNGARLHQKVFEERFYYVVADKMGYLTWGEASSWGMDCNDTETARNFITEWSEIV QRDRNHPSLLIWTPTNEEFWPDRVQYPRLMHDLYNLTKMIDPTRPPFHGASGGTHIA TDIWTVHNYEQDPAKLKEKLYNGGKLMEAPKWEIHLMPMNIGYNGLKYTDQYAFPE YKKDMPYLVDEFGGIKWNPSQQMESAQNTSWGYGEPPRSLEEFYARLEGQVDAVLS LSNDIWGYCYTQLTDVEQEQNGIYYYDRTPKFDMKRIHAIFSKTPESK<br>(PmGUS: *Parabacteroides sp. merdae* BGUS) |
| 15 | MLYPINTETRGVFDLNGVWNFKLDYGKGLEEKWYESKLTDTISMAVPSSYNDIGVTK EIRNHIGYVWYEREFTVPAYLKDQRIVLRFGSATHKAIVYVNGELVVEHKGGFLPFEA EINNSLRDGMNRVTVAVDNILDDSTLPVGLYSERHEEGLGKVIRNKPNFDFFNYAGLH RPVKIYTTPFTYVEDISVVTDFNGPTGTVTYTVDFQGKAETVKVSVVDEEGKVVASTE GLSGNVEIPNVILWEPLNTYLYQIKVELVNDGLTIDVYEEPFGVRTVEVNDGKFLINNK PFYFKGFGKHEDTPINGRGFNEASNVMDFNILKWIGANSFRTAHYPYSEELMRLADR EGLVVIDETPAVGVHLNFMATTGLGEGSERVSTWEKIRTFEHHQDVLRELVSRDKNH PSVVMWSIANEAATEEEGAYEYFKPLVELTKELDPQKRPVTIVLFVMATPETDKVAE LIDVIALNRYNGWYFDGGDLEAAKVHLRQEFHAWNKRCPGKPIMITEYGADTVAGFH DIDPVMFTEEYQVEYYQANHVVFDEFENFVGEQAWNFADFATSQGVMRVQGNKKG VFTRDRKPKLAAHVFRERWTNIPDFGYKN<br>(StpGUS: *Staphylococcus sp.* RLH1 BGUS) |
| 16 | MLYPLLTKTRNTYDLGGIWNFKLGEHNPNELLPSDEVMVIPTSFNDLMVSKEKRDYI GDFWYEKVIEVPKVSEGEEMVLRFGSVTHQAKIYVDGILVGEHKGGFTPFEVLVPECK YNNEKIKVSICANNVLDYTTLPVGNYSEIIQEDGSIKKKVRENFDFFNYAGVHRPLKLM IRPKNHISDITITSRLSDDLQSADLHFLVETNQKVDEVRISVFDEDNKLVGETKDSRLF LSDVHLWEVLNAYLYTARVEIFVDNQLQDVYEENFGLREIEVTNGQFLLNRKPIYFKG FGKHEDTFINGRGLNEAANLMDLNLLKDIGANSFRTSHYPYSEEMMRLADRMGVLVI DEVPAVGLFQNFNASLDLSPKDNGTWSLMQTKAAHEQAIQELVKRDKNHPSVVMW VVANEPASHEAGAHDYFEPLVKLYKDLDPQKRPVTLVNILMATPDRDQVMDLVDVV CLNRYYGWYVDHGDLTNAEVGLRKELLEWQDKFPDKPIIITEYGADTLPGLHSTWNI |

SUMMARY OF SEQUENCE LISTING

| SEQ ID NO: | DESCRIPTION |
|---|---|
| | PYTEEFQCDFYEMSHRVFDGIPNLVGEQVWNFADFETNLMILRVQGNHKGLFSRNR<br>QPKQVVKEFKKRWMTIPHYHNKKNSVK<br>(SaGUS: *Streptococcus agalactiae* BGUS) |
| 17 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGKHEDTNIRGKGHDDAYMVHDFQLLHWMGANSFRTSHYPYAEEVMEY<br>ADRQGIVVIDETPAVGLAFSIGAGAQTSNPPATFSPDRINNKTREAHAQAIRELIHRDK<br>NHPSVVMWSIANEPASNEDGAREYFAPLPKLARQLDPTRPVTFANVGLATYKADRIA<br>DLFDVLCLNRYFGWYTQTAELDEAEAALEEELRGWTEKYDKPIVMTEYGADTVAGL<br>HSVMVTPWSEEFQVEMLDMYHRVFDRFEAMAGEQVWNFADFQTAVGVSRVDGNK<br>KGVFTRDRKPKAAAHLLRKRWTNLHNGTAEGSKTFQ<br>(Rxn1 chimera) |
| 18 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGRHEDADLRGKGFDNVLMVHDHALMDWIGANSYRTSHYPYAEEMLDW<br>ADEHGIVVIDETAAVGFNLSLGIGFEAGNKPKELYSEEAVNGETQQAHLQAIKELIARD<br>KNHPSVVMWSIANEPDTRPQGAREYFAPLAEATRKLDPTRPITCVNVMFCDAHTDTI<br>SDLFDVLCLNRYYGWYVQSGDLETAEKVLEKELLAWQEKLHQPIIITEYGVDTLAGLH<br>SMYTDMWSEEYQCAWLDMYHRVFDRVSAVVGEQVWNFADFATSQSILRVGGNKKG<br>IFTRDRKPKSAAFLLQKRWTGMNFGEKPQQGSKTFQ<br>(Rxn2 chimera) |
| 19 | MLKPQQTTTRDLISLDGLWKFALASDDNNTQPWTSQLKTSLECPVPASYNDIFADSK<br>IHDHVGWVYYQRDVIVPKGWSEEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGDATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGIIRVDGNKKGVFTR<br>ERKPKAAAHTLKTRWSGMLGSDH<br>(Rxn3 chimera) |
| 20 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGRHEDADLRGKGFDNVLMVHDHALMDWIGANSYRTSHYPYAEEMLDW<br>ADEHGIVVIDETAAVGFNLSLGIGFEAGNKPKELYSEEAVNGETQQAHLQAIKELIARD<br>KNHPSVVMWSIANEPDTRPQGAREYFAPLAEATRKLDPTRPITCVNVMFCDAHTDTI<br>SDLFDVLCLNRYYGWYVQSGDLETAEKVLEKELLAWQEKLHQPIIITEYGVDTLAGLH<br>SMYTDMWSEEYQCAWLDMYHRVFDRVSAVVGEQVWNFADFATSQSILRVGGNKKG<br>IFTRDRKPKSAAFLLQKRWTGMNFGEKPQQGSDH<br>(Rxn4 chimera) |
| 21 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGRHEDADLRGKGFDNVLMVHDHALMDWIGANSYRTSHYPYAEEMLDW<br>ADEHGIVVIDETAAVGFNLSLGIGFEAGNKPKELYSEEAVNGETQQAHLQAIKELIARD<br>KNHPSVVMWSIANEPDTRPQGAREYFAPLAEATRKLDPTRPITCVNVMFCDAHTDTI<br>SDLFDVLCLNRYYGWYVQSGDLETAEKVLEKELLAWQEKLHQPIIITEYGVDTLAGLH<br>SMYTDMWSEEYQCAWLDMYHRVFDRVSAVVGEQVWNFADFATSQSILRVGGNKKG<br>IFTRDRKPKSAAFLLQKRWTGMNFGEKPQQGSKQGLCGR<br>(Rxn5 chimera) |
| 22 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG |

SUMMARY OF SEQUENCE LISTING

| SEQ ID NO: | DESCRIPTION |
|---|---|
| | ARGSVTIDSVKLWQPGEAYLYQFRASIVGLNDSVVDTYCVETGVRTVKVSGNRFLIND KPFYFTGFGRHEDADLRGKGFDNVLMVHDHALMDWIGANSYRTSHYPYAEEMLDW ADEHGIVVIDETAAVGFNLSLGIGFEAGNKPKELYSEEAVNGETQQAHLQAIKELIARD KNHPSVVMWSIANEPDTRPQGAREYFAPLAEATRKLDPTRPITCVNVMFCDAHTDTI SDLFDVLCLNRYYGWYVQSGDLETAEKVLEKELLAWQEKLHQPIIITEYGVDTLAGLH SMYTDMWSEEYQCAWLDMYHRVFDRVSAVVGEQVWNFADFATSQSILRVGGNKKG IFTRDRKPKSAAFLLQKRWTGMNFGEKPQQGSKQGLCGR (Rxn8 chimera) |
| 23 | MLRPVETPTREIKKLDGLWAFSLDRENCGIDQRWWESALQESRAIAVPGSFNDQFAD ADIRNYAGNVWYQREVFIPKGWAGQRIVLRFDAVTHYGKVWVNNQEVMEHQGGYT PFEADVTPYVIAGKSVRITVCVNNELNWQTIPPGMVITDENGKKKQSYFHDFFNYAGI HRSVMLYTTPNTWVDDITVVTHVAQDCNHASVDWQVVANGDVSVELRDADQQVVA TGQGTSGTLQVVNPHLWQPGEGYLYELCVTAKSQTECDIYPLRVGIRSVAVKGEQFLI NHKPFYFTGFGKHEDTNIRGKGHDDAYMVHDFQLLHWMGANSFRTSHYPYAEEVM EYADRQGIVVIDETPAVGLAFSIGAGAQTSNPPATFSPDRINNKTREAHAQAIRELIHR DKNHPSVVMWSIANEPASNEDGAREYFAPLPKLARQLDPTRPVTFANVGLATYKAD RIADLFDVLCLNRYFGWYTQTAELDEAEAALEEELRGWTEKYDKPIVMTEYGADTVA GLHSVMVTPWSEEFQVEMLDMYHRVFDRFEAMAGEQVWNFADFQTAVGVSRVDG NKKGVFTRDRKPKAAAHLLRKRWTNLHNGTAEGSKQGLCGR (Rxn9 chimera) |
| 24 | MLRPVETPTREIKKLDGLWAFSLDRENCGIDQRWWESALQESRAIAVPGSFNDQFAD ADIRNYAGNVWYQREVFIPKGWAGQRIVLRFDAVTHYGKVWVNNQEVMEHQGGYT PFEADVTPYVIAGKSVRITVCVNNELNWQTIPPGMVITDENGKKKQSYFHDFFNYAGI HRSVMLYTTPNTWVDDITVVTHVAQDCNHASVDWQVVANGDVSVELRDADQQVVA TGQGTSGTLQVVNPHLWQPGEGYLYELCVTAKSQTECDIYPLRVGIRSVAVKGEQFLI NHKPFYFTGFGKHEDSAVRGKGYDPAYMVHDFQLMDWMGANSFRTSHYPYAEEVM EFADRHGIVVIDETPAVGLAFSIGSGVSSEDSPQTFTPEGINNNTREAHKQAIRELIARD KNHASVVMWSIANEPASQEVGAREYFAPLVDLAHELDPSRPVCFANYGDATYEVDRI SDMFDVLCLNRYFGWYSQTGEVEEAEAALEKELLGWEGKYGKPIVITEYGADTMAGL HSVLALPWSEEFQVLLDMYHRVFDRIDSVVGEHVWNFADFQTAVGIIRVDGNKKGV FTRERKPKAAAHTLKTRWSGMLGSKQGLCGR (Rxn10 chimera) |
| 25 | MLKPRQTPFRDLISLDGLWKFALDSGDNATAAPWTGPLTTDLECPVPASYNDIFVDR QIRDHVGWVYYQREAIVPRAWSQQQYLVRVDAATHQGRIYINDNLVAEHRGGYTPFE ADITGLVSAGDSFRLTIAVNNELTHETIPPGRIEVEEYTGKRVQVYQHDFFNYAGLARS VWLYSVPQQHIQDIKVVTHVKGSAGLINYLVTVSNSTTGRVKIDVIDKDGTTVAEASG ARGSVTIDSVKLWQPGEAYLYQFRASIVGLNDSVVDTYCVETGVRTVKVSGNRFLIND KPFYFTGFGKHEDSAVRGKGYDPAYMVHDFQLMDWMGANSFRTSHYPYAEEVMEF ADRHGIVVIDETPAVGLAFSIGSGVSSEDSPQTFTPEGINNNTREAHKQAIRELIARDK NHASVVMWSIANEPASNEDGAREYFAPLPKLARQLDPTRPVTFANVGLATYKADRIA DLFDVLCLNRYFGWYTQTAELDEAEAALEEELRGWTEKYDKPIVMTEYGADTVAGL HSVMVTPWSEEFQVEMLDMYHRVFDRFEAMAGEQVWNFADFQTAVGVSRVDGNK KGVFTRDRKPKAAAHLLRKRWTNLHNGTAEGSKTFQ (Save1 chimera) |
| 26 | MLKPQQTTTRDLISLDGLWKFALASDDNNTQPWTSQLKTSLECPVPASYNDIFADSK IHDHVGWVYYQRDVIVPKGWSEERYLVRCEAATHHGRIYVNGNLVADHVGGYTPFE ADITDLVAAGEQFRLTIAVDNELTYQTIPPGKVEILEATGKKVQTYQHDFYNYAGLAR SVWLYSVPQQHIQDITVRTDVQGTTGLIDYNVVASTTQGTIQVAVIDEDGTTVATSSGS NGTIHIPSVHLWQPGAAYLYQLHASIIDSSKKTIDTYKLATGIRTVKVQGTQFLINDKP FYFTGFGKHEDTNIRGKGHDDAYMVHDFQLLHWMGANSFRTSHYPYAEEVMEYAD RQGIVVIDETPAVGLAFSIGAGAQTSNPPATFSPDRINNKTREAHAQAIRELIHRDKNH PSVVMWSIANPASQEVGAREYFAPLVDLAHELDPSRPVCFANYGDATYEVDRISDMF DVLCLNRYFGWYSQTGEVEEAEAALEKELLGWEGKYGKPIVITEYGADTMAGLHSVL ALPWSEEFQVLLDMYHRVFDRIDSVVGEHVWNFADFQTAVGIIRVDGNKKGVFTR ERKPKAAAHTLKTRWSGMLGSDH (Save3 chimera) |
| 27 | MLKPRQTPFRDLISLDGLWKFALDSGDNATAAPWTGPLTTDLECPVPASYNDIFVDR QIRDHVGWVYYQREAIVPRAWSQQQYLVRVDAATHQGRIYINDNLVAEHRGGYTPFE ADITGLVSAGDSFRLTIAVNNELTHETIPPGRIEVEEYTGKRVQVYQHDFFNYAGLARS VWLYSVPQQHIQDIKVVTHVKGSAGLINYLVTVSNSTTGRVKIDVIDKDGTTVAEASG ARGSVTIDSVKLWQPGEAYLYQFRASIVGLNDSVVDTYCVETGVRTVKVSGNRFLIND KPFYFTGFGRHEDADLRGKGFDNVLMVHDHALMDWIGANSYRTSHYPYAEEMLDW ADEHGIVVIDETPAVGLAFSIGSGVSSEDSPQTFTPEGINNNTREAHKQAIRELIARDK NHASVVMWSIANEPDTRPQGAREYFAPLAEATRKLDPTRPITCVNVMFCDAHTDTIS DLFDVLCLNRYYGWYVQSGDLETAEKVLEKELLAWQEKLHQPIIITEYGVDTLAGLHS MYTDMWSEEYQCAWLDMYHRVFDRVSAVVGEQVWNFADFATSQSILRVGGNKKGI FTRDRKPKSAAFLLQKRWTGMNFGEKPQQGSDH (Save4 chimera) |

US 11,268,079 B2

43                                        44
-continued

| SUMMARY OF SEQUENCE LISTING |
| --- |

| SEQ ID NO: | DESCRIPTION |
| --- | --- |
| 28 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGRHEDADLRGKGFDNVLMVHDHALMDWIGANSYRTSHYPYAEEMLDW<br>ADEHGIVVIDETPAVGLAFSIGAGAQTSNPPATFSPDRINNKTREAHAQAIRELIHRDK<br>NHPSVVMWSIANEPDTRPQGAREYFAPLAEATRKLDPTRPITCVNVMFCDAHTDTIS<br>DLFDVLCLNRYYGWYVQSGDLETAEKVLEKELLAWQEKLHQPIIITEYGVDTLAGLHS<br>MYTDMWSEEYQCAWLDMYHRVFDRVSAVVGEQVWNFADFATSQSILRVGGNKKGI<br>FTRDRKPKSAAFLLQKRWTGMNFGEKPQQGSKQGLCGR<br>(Save5 chimera) |
| 29 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDFFNYAGI<br>HRSVMLYTTPNTWVDDITVVTHVAQDCNHASVDWQVVANGDVSVELRDADQQVVA<br>TGQGTSGTLQVVNPHLWQPGEGYLYELCVTAKSQTECDIYPLRVGIRSVAVKGEQFLI<br>NHKPFYFTGFGRHEDADLRGKGFDNVLMVHDHALMDWIGANSYRTSHYPYAEEML<br>DWADEHGIVVIDETAAVGFNLSLGIGFEAGNKPKELYSEEAVNGETQQAHLQAIKELI<br>ARDKNHPSVVMWSIANEPASNEDGAREYFAPLPKLARQLDPTRPVTFANVGLATYK<br>ADRIADLFDVLCLNRYFGWYTQTAELDEAEAALEEELRGWTEKYDKPIVMTEYGADT<br>VAGLHSVMVTPWSEEFQVEMLDMYHRVFDRFEAMAGEQVWNFADFQTAVGVSRV<br>DGNKKGVFTRDRKPKAAAHLLRKRWTNLHNGTAEGSKQGLCGR<br>(Save9 chimera) |
| 30 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDFFNYAGI<br>HRSVMLYTTPNTWVDDITVVTHVAQDCNHASVDWQVVANGDVSVELRDADQQVVA<br>TGQGTSGTLQVVNPHLWQPGEGYLYELCVTAKSQTECDIYPLRVGIRSVAVKGEQFLI<br>NHKPFYFTGFGKHEDSAVRGKGYDPAYMVHDFQLMDWMGANSFRTSHYPYAEEVM<br>EFADRHGIVVIDETAAVGFNLSLGIGFEAGNKPKELYSEEAVNGETQQAHLQAIKELIA<br>RDKNHPSVVMWSIANEPASQEVGAREYFAPLVDLAHELDPSRPVCFANYGDATYEVD<br>RISDMFDVLCLNRYFGWYSQTGEVEEAEAALEKELLGWEGKYGKPIVITEYGADTMA<br>GLHSVLALPWSEEFQVQLLDMYHRVFDRIDSVVGEHVWNFADFQTAVGIIRVDGNKK<br>GVFTRERKPKAAAHTLKTRWSGMLGSKQGLCGR<br>(Save10 chimera) |
| 31 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDTNIRGKGHDDAYMVHDFQLLHWMGANSFRTSHYPYAEEVMEYAD<br>RQGIVVIDETPAVGLAFSIGGSVSSEDSPQTFTPEGINNNTREAHKQAIRELIARDKNH<br>ASVVMWSIANEPASNEDGAREYFAPLPKLARQLDPTRPVTFANVGLATYKADRIADL<br>FDVLCLNRYFGWYTQTAELDEAEAALEEELRGWTEKYDKPIVMTEYGADTVAGLHS<br>VMVTPWSEEFQVEMLDMYHRVFDRFEAMAGEQVWNFADFQTAVGVSRVDGNKKG<br>VFTRDRKPKAAAHLLRKRWTNLHNGTAEGSKTFQ<br>(L1 chimera) |
| 32 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGRHEDADLRGKGFDNVLMVHDHALMDWIGANSYRTSHYPYAEEMLDWAD<br>EHGIVVIDETAAVGFNLSLGIGFEAGNKPKELYSEEAVNGETQQAHLQAIKELIARDKN<br>HPSVVMWSIANEPASNEDGAREYFAPLPKLARQLDPTRPVTFANVGLATYKADRIAD<br>LFDVLCLNRYFGWYTQTAELDEAEAALEEELRGWTEKYDKPIVMTEYGADTVAGLH<br>SVMVTPWSEEFQVEMLDMYHRVFDRFEAMAGEQVWNFADFQTAVGVSRVDGNKK<br>GVFTRDRKPKAAAHLLRKRWTNLHNGTAEGSKTFQ<br>(L2 chimera) |
| 33 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGKHEDTNIRGKGHDDAYMVHDFQLLHWMGANSFRTSHYPYAEEVMEY<br>ADRQGIVVIDETPAVGLAFSIGAGAQTSNPPATFSPDRINNKTREAHAQAIRELIHRDK |

SUMMARY OF SEQUENCE LISTING

| SEQ ID NO: | DESCRIPTION |
|---|---|
|  | NHPSVVMWSIANEPASQEVGAREYFAPLVDLAHELDPSRPVCFANYGDATYEVDRIS<br>DMFDVLCLNRYFGWYSQTGEVEEAEAALEKELLGWEGKYGKPIVITEYGADTMAGLH<br>SVLALPWSEEFQVQLLDMYHRVFDRIDSVVGEHVWNFADFQTAVGIIRVDGNKKGVF<br>TRERKPKAAAHTLKTRWSGMLGSDH<br>(L3 chimera) |
| 34 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGKHEDSAVRGKGYDPAYMVHDFQLMDWMGANSFRTSHYPYAEEVMEF<br>ADRHGIVVIDETAAVGFNLSLGIGFEAGNKPKELYSEEAVNGETQQAHLQAIKELIARD<br>KNHPSVVMWSIANEPASQEVGAREYFAPLVDLAHELDPSRPVCFANYGDATYEVDRI<br>SDMFDVLCLNRYFGWYSQTGEVEEAEAALEKELLGWEGKYGKPIVITEYGADTMAGL<br>HSVLALPWSEEFQVQLLDMYHRVFDRIDSVVGEHVWNFADFQTAVGIIRVDGNKKGV<br>FTRERKPKAAAHTLKTRWSGMLGSDH<br>(L4 chimera) |
| 35 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDFFNYAGI<br>HRSVMLYTTPNTWVDDITVVTHVAQDCNHASVDWQVVANGDVSVELRDADQQVVA<br>TGQGTSGTLQVVNPHLWQPGEGYLYELCVTAKSQTECDIYPLRVGIRSVAVKGEQFLI<br>NHKPFYFTGFGKHEDTNIRGKGHDDAYMVHDFQLLHWMGANSFRTSHYPYAEEVM<br>EYADRQGIVVIDETPAVGLAFSIGAGAQTSNPPATFSPDRINNKTREAHAQAIRELIHR<br>DKNHPSVVMWSIANEPDTRPQGAREYFAPLAEATRKLDPTRPITCVNVMFCDAHTD<br>TISDLFDVLCLNRYYGWYVQSGDLETAEKVLEKELLAWQEKLHQPIIITEYGVDTLAG<br>LHSMYTDMWSEEYQCAWLDMYHRVFDRVSAVVGEQVWNFADFATSQSILRVGGNK<br>KGIFTRDRKPKSAAFLLQKRWTGMNFGEKPQQGSKQGLCGR<br>(L5 chimera) |
| 36 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDFFNYAGI<br>HRSVMLYTTPNTWVDDITVVTHVAQDCNHASVDWQVVANGDVSVELRDADQQVVA<br>TGQGTSGTLQVVNPHLWQPGEGYLYELCVTAKSQTECDIYPLRVGIRSVAVKGEQFLI<br>NHKPFYFTGFGRHEDADLRGKGFDNVLMVHDHALMDWIGANSYRTSHYPYAEEML<br>DWADEHGIVVIDETPAVGLAFSIGSGVSSEDSPQTFTPEGINNNTREAHKQAIRELIAR<br>DKNHASVVMWSIANEPDTRPQGAREYFAPLAEATRKLDPTRPITCVNVMFCDAHTD<br>TISDLFDVLCLNRYYGWYVQSGDLETAEKVLEKELLAWQEKLHQPIIITEYGVDTLAG<br>LHSMYTDMWSEEYQCAWLDMYHRVFDRVSAVVGEQVWNFADFATSQSILRVGGNK<br>KGIFTRDRKPKSAAFLLQKRWTGMNFGEKPQQGSKQGLCGR<br>(L6 chimera) |
| 37 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGGKANMMSGMMGGMGAGASDK<br>PQNNPNFDFFNYAGLNRPVKITVTNKEYIHDIDILSDVNGSDGIVNYEVHTTGENKVYI<br>KINDEEGKEVASCEGKSGKIVIKDAKLWNPKAAYLYKFIACIKNGDELIDEYYLDFGIR<br>TVKVEGTKFLINGKPFYFTGFGKHEDSEIAGRGYNPPVIKRDFELIKWVGANSFRTSHY<br>PYSEEIMQAADREGIVIIDEVAAVGMFDVGSVLNPSASKTDYFSLDEVHSKTKEVHKK<br>AVEELIKRDKNHPSVVMWSLFNEPDTSKDEAVPYFEDIFNFAKSQDKQNLPKTFAAI<br>QASSPGKCKCMHLCDVITLNRYYGWYFLGGYEIDMSEEKFREEMNLYSNMNKPVMF<br>TEYGADTYAGVHKLPSVMWSEEYQCEYYEMNFKVFDSYDFIVGEQLWNFADFQTTE<br>GIFRVDGNKKGIFTRNRQPKAVAHLIRSRWNKLPLDYKSKK<br>(BpChimera1 chimera) |
| 38 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTEKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDQFGGGANFGGERIGTFDKEHGSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpChimera2 chimera) |
| 39 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF |

SUMMARY OF SEQUENCE LISTING

| SEQ ID NO: | DESCRIPTION |
|---|---|
| | MPFNAPVNEAGIFGEKNKLVVVVNNELSNTTIPCGGKANMMSGMMGGMGAGASDK<br>PQNNPNFDFFNYAGLNRPVKITVTNKEYIHDIDILSDVNGSDGIVNYEVHTTGENKVYI<br>KINDEEGKEVASCEGKSGKIVIKDAKLWNPKAAYLYKFIACIKNGDELIDEYYLDFGIR<br>TVKVEGTKFLINGKPFYFTGFGKHEDSEIAGRGYNPPVIKRDFELIKWVGANSFRTSHY<br>PYSEEIMQAADREGIVIIDEVAAVGMFDQFGGGANFGGERIGTFDKEHGSKTKEVHKK<br>AVEELIKRDKNHPSVVMWSLFNEPDTSKDEAVPYFEDIFNFAKSQDKQNLPKTFAAI<br>QASSPGKCKCMHLCDVITLNRYYGWYFLGGYEIDMSEEKFREEMNLYSNMNKPVMF<br>TEYGADTYAGVHKLPSVMWSEEYQCEYYEMNFKVFDSYDFIVGEQLWNFADFQTTE<br>GIFRVDGNKKGIFTRNRQPKAVAHLIRSRWNKLPLDYKSKK<br>(BpChimera3 chimera) |
| 40 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGGGGANFGGERDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpChimera4 chimera) |
| 41 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGGKANMMSGMMGGMGAGASDK<br>PQNNPNFDFFNYAGLNRPVKITVTNKEYIHDIDILSDVNGSDGIVNYEVHTTGENKVYI<br>KINDEEGKEVASCEGKSGKIVIKDAKLWNPKAAYLYKFIACIKNGDELIDEYYLDFGIR<br>TVKVEGTKFLINGKPFYFTGFGKHEDSEIAGRGYNPPVIKRDFELIKWVGANSFRTSHY<br>PYSEEIMQAADREGIVIIDEVAAVGMFDVGGGGANFGGERDYFSLDEVHSKTKEVHKK<br>AVEELIKRDKNHPSVVMWSLFNEPDTSKDEAVPYFEDIFNFAKSQDKQNLPKTFAAI<br>QASSPGKCKCMHLCDVITLNRYYGWYFLGGYEIDMSEEKFREEMNLYSNMNKPVMF<br>TEYGADTYAGVHKLPSVMWSEEYQCEYYEMNFKVFDSYDFIVGEQLWNFADFQTTE<br>GIFRVDGNKKGIFTRNRQPKAVAHLIRSRWNKLPLDYKSKK<br>(BpChimera5 chimera) |
| 42 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGCGHTETKPSGKKYIKPSFDFFNYCGITRP<br>VKIYTTPETYINDITVTADIDFTKEEPSAVLNYNVEIKGKDYNNITCKVELFDEEGTKLS<br>ETEGSEGTFEISNVRLWQPLNAYLYKIKVTAGQDVYTLPYGVRSVRVDGTKFLINEKP<br>FYFKGYGKHEDTFPNGRGINLPMNTKDISIMKWQHANSFRTSHYPYSEEMMRLCDE<br>EGIVVIDETTAVGVNLQFGGGANFGGERIGTFDKEHGVQTQEHHKDVIRDLISRDKNH<br>ACVVMWSIANEPDSAAEGAYDYFKPLYDLARELDPQKRPCTLVSVQGTTADTDCSSQ<br>LSDVICLNRYYGWYFGGPDLEVSEIGLRKELSDWGKLGKPVMFTEYGADTVSGLHDT<br>TSVMYTEEYQVEYYEMNNKVFDEFDFVVGEQAWNFADFATSQSLLRVQGNKKGLFT<br>RDRKPKMVAHYFRNRWSTIPEFGYKTK<br>(EeChimera1 chimera) |
| 43 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLVGSVLNPSASKTDYFSLDEVHVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeChimera2 chimera) |
| 44 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGCGHTETKPSGKKYIKPSFDFFNYCGITRP<br>VKIYTTPETYINDITVTADIDFTKEEPSAVLNYNVEIKGKDYNNITCKVELFDEEGTKLS<br>ETEGSEGTFEISNVRLWQPLNAYLYKIKVTAGQDVYTLPYGVRSVRVDGTKFLINEKP<br>FYFKGYGKHEDTFPNGRGINLPMNTKDISIMKWQHANSFRTSHYPYSEEMMRLCDE<br>EGIVVIDETTAVGVNLVGSVLNPSASKTDYFSLDEVHVQTQEHHKDVIRDLISRDKNH<br>ACVVMWSIANEPDSAAEGAYDYFKPLYDLARELDPQKRPCTLVSVQGTTADTDCSSQ |

SUMMARY OF SEQUENCE LISTING

| SEQ ID NO: | DESCRIPTION |
|---|---|
| | LSDVICLNRYYGWYFGGPDLEVSEIGLRKELSDWGKLGKPVMFTEYGADTVSGLHDT<br>TSVMYTEEYQVEYYEMNNKVFDEFDFVVGEQAWNFADFATSQSLLRVQGNKKGLFT<br>RDRKPKMVAHYFRNRWSTIPEFGYKTK<br>(EeChimera3 chimera) |
| 45 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFSVLNPSASKTIGTFDKEHGVQTQEHHKD<br>VIRDLISRDKNHACVVMWSIANEPDSAAEGAYDYFKPLYDLARELDPQKRPCTLVSVQ<br>GTTADTDCSSQLSDVICLNRYYGWYFGGPDLEVSEIGLRKELSDWGKLGKPVMFTEYG<br>ADTVSGLHDTTSVMYTEEYQVEYYEMNNKVFDEFDFVVGEQAWNFADFATSQSLLR<br>VQGNKKGLFTRDRKPKMVAHYFRNRWSTIPEFGYKTK<br>(EeChimera4 chimera) |
| 46 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGCGHTETKPSGKKYIKPSFDFFNYCGITRP<br>VKIYTTPETYINDITVTADIDFTKEEPSAVLNYNVEIKGKDYNNITCKVELFDEEGTKLS<br>ETEGSEGTFEISNVRLWQPLNAYLYKIKVTAGQDVYTLPYGVRSVRVDGTKFLINEKP<br>FYFKGYGKHEDTFPNGRGINLPMNTKDISIMKWQHANSFRTSHYPYSEEMMRLCDE<br>EGIVVIDETTAVGVNLQFSVLNPSASKTIGTFDKEHGVQTQEHHKDVIRDLISRDKNH<br>ACVVMWSIANEPDSAAEGAYDYFKPLYDLARELDPQKRPCTLVSVQGTTADTDCSSQ<br>LSDVICLNRYYGWYFGGPDLEVSEIGLRKELSDWGKLGKPVMFTEYGADTVSGLHDT<br>TSVMYTEEYQVEYYEMNNKVFDEFDFVVGEQAWNFADFATSQSLLRVQGNKKGLFT<br>RDRKPKMVAHYFRNRWSTIPEFGYKTK<br>(EeChimera5 chimera) |
| 47 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYATGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294A) |
| 48 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYITGFGKHEDSEIAGRGYNPPVIKRDFELIKWVGANSFRTSHYPYSEEIMQAADREG<br>IVIIDEVAAVGMFDVGSVLNPSASKTDYFSLDEVHSKTKEVHKKAVEELIKRDKNHPS<br>VVMWSLFNEPDTSKDEAVPYFEDIFNFAKSQDKQNLPKTFAAIQASSPGKCKCMHLC<br>DVITLNRYYGWYFLGGYEIDMSEEKFREEMNLYSNMNKPVMFTEYGADTYAGVHKL<br>PSVMWSEEYQCEYYEMNFKVFDSYDFIVGEQLWNFADFQTTEGIFRVDGNKKGIFTR<br>NRQPKAVAHLIRSRWNKLPLDYKSKK<br>(BpF294I) |
| 49 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYVTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294V) |
| 50 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG |

| SEQ ID NO: | DESCRIPTION |
|---|---|
| | LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y) |
| 51 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYLTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294L) |
| 52 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYWTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294W) |
| 53 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYWKGYGKHEDTFPNGRGINLPMNTKDISIMKWQHANSFRTSH<br>YPYSEEMMRLCDEEGIVVIDETTAVGVNLQFGGGANFGGERIGTFDKEHGVQTQEHH<br>KDVIRDLISRDKNHACVVMWSIANEPDSAAEGAYDYFKPLYDLARELDPQKRPCTLV<br>SVQGTTADTDCSSQLSDVICLNRYYGWYFGGPDLEVSEIGLRKELSDWGKLGKPVMFT<br>EYGADTVSGLHDTTSVMYTEEYQVEYYEMNNKVFDEFDFVVGEQAWNFADFATSQS<br>LLRVQGNKKGLFTRDRKPKMVAHYFRNRWSTIPEFGYKTK<br>(EeF303W) |
| 54 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYSKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeF303S) |
| 55 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFAGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL |

SUMMARY OF SEQUENCE LISTING

| SEQ ID NO: | DESCRIPTION |
|---|---|
| | CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295A) |
| 56 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFCGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295C) |
| 57 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFFGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295F) |
| 58 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFIGFGKHEDSEIAGRGYNPPVIKRDFELIKWVGANSFRTSHYPYSEEIMQAADREG<br>IVIIDEVAAVGMFDVGSVLNPSASKTDYFSLDEVHSKTKEVHKKAVEELIKRDKNHPS<br>VVMWSLFNEPDTSKDEAVPYFEDIFNFAKSQDKQNLPKTFAAIQASSPGKCKCMHLC<br>DVITLNRYYGWYFLGGYEIDMSEEKFREEMNLYSNMNKPVMFTEYGADTYAGVHKL<br>PSVMWSEEYQCEYYEMNFKVFDSYDFIVGEQLWNFADFQTTEGIFRVDGNKKGIFTR<br>NRQPKAVAHLIRSRWNKLPLDYKSKK<br>(BpT295I) |
| 59 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFKGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295K) |
| 60 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFSGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295S) |
| 61 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG |

SUMMARY OF SEQUENCE LISTING

| SEQ ID NO: | DESCRIPTION |
|---|---|
| | LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFVGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295V) |
| 62 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFAGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeK304A) |
| 63 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFVGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeK304V) |
| 64 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAFQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpI450F) |
| 65 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAKQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpI450K) |
| 66 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAALQASSPGKCKCMHL |

| SEQ ID NO: | DESCRIPTION |
|---|---|
| | CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpI450L) |
| 67 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAMQASSPGKCKCMH<br>LCDVITLNRYYGWYFLGGYEIDMSEEKFREEMNLYSNMNKPVMFTEYGADTYAGVH<br>KLPSVMWSEEYQCEYYEMNFKVFDSYDFIVGEQLWNFADFQTTEGIFRVDGNKKGIF<br>TRNRQPKAVAHLIRSRWNKLPLDYKSKK<br>(BpI450M) |
| 68 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAQQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpI450Q) |
| 69 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKVVVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAADQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpI450D) |
| 70 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKVVVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAVQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpI450V) |
| 71 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELPFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSF<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeV459F) |
| 72 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP |

-continued

| SUMMARY OF SEQUENCE LISTING | |
|---|---|
| SEQ ID NO: | DESCRIPTION |
| | NFDFFNYCGITRPVKIYTTPETYINDITVTADIDFTKEEPSAVLNYNVEIKGKDYNNITC KVELFDEEGTKLSETEGSEGTFEISNVRLWQPLNAYLYKIKVTAGQDVYTLPYGVRSV RVDGTKFLINEKPFYFKGYGKHEDTFPNGRGINLPMNTKDISIMKWQHANSFRTSHY PYSEEMMRLCDEEGIVVIDETTAVGVNLQFGGGANFGGERIGTFDKEHGVQTQEHHK DVIRDLISRDKNHACVVMWSIANEPDSAAEGAYDYFKPLYDLARELDPQKRPCTLVSL QGTTADTDCSSQLSDVICLNRYYGWYFGGPDLEVSEIGLRKELSDWGKLGKPVMFTE YGADTVSGLHDTTSVMYTEEYQVEYYEMNNKVFDEFDFVVGEQAWNFADFATSQSL LRVQGNKKGLFTRDRKPKMVAHYFRNRWSTIPEFGYKTK (EeV459L) |
| 73 | MLYPVLTQSRLLSDLSGVWDFKLDNGKGFEEKWYEKPLKDADTMPVPASYNDLKEG TDFRDHYGWVFYQRNISVPEYVKSQRIVLRCAAVTHYAMIYLNGKLICEHKGGFLPFE VELNDDLQDGDNLLTIAVNNVIDYTTLPVGGKANMMSGMMGGMGAGASDKPQNNP NFDFFNYCGITRPVKIYTTPETYINDITVTADIDFTKEEPSAVLNYNVEIKGKDYNNITC KVELFDEEGTKLSETEGSEGTFEISNVRLWQPLNAYLYKIKVTAGQDVYTLPYGVRSV RVDGTKFLINEKPFYFKGYGKHEDTFPNGRGINLPMNTKDISIMKWQHANSFRTSHY PYSEEMMRLCDEEGIVVIDETTAVGVNLQFGGGANFGGERIGTFDKEHGVQTQEHHK DVIRDLISRDKNHACVVMWSIANEPDSAAEGAYDYFKPLYDLARELDPQKRPCTLVS WQGTTADTDCSSQLSDVICLNRYYGWYFGGPDLEVSEIGLRKELSDWGKLGKPVMFT EYGADTVSGLHDTTSVMYTEEYQVEYYEMNNKVFDEFDFVVGEQAWNFADFATSQS LLRVQGNKKGLFTRDRKPKMVAHYFRNRWSTIPEFGYKTK (EeV459W) |
| 74 | MLYPVLTQSRLLSDLSGVWDFKLDNGKGFEEKWYEKPLKDADTMPVPASYNDLKEG TDFRDHYGWVFYQRNISVPEYVKSQRIVLRCAAVTHYAMIYLNGKLICEHKGGFLPFE VELNDDLQDGDNLLTIAVNNVIDYTTLPVGGKANMMSGMMGGMGAGASDKPQNNP NFDFFNYCGITRPVKIYTTPETYINDITVTADIDFTKEEPSAVLNYNVEIKGKDYNNITC KVELFDEEGTKLSETEGSEGTFEISNVRLWQPLNAYLYKIKVTAGQDVYTLPYGVRSV RVDGTKFLINEKPFYFKGYGKHEDTFPNGRGINLPMNTKDISIMKWQHANSFRTSHY PYSEEMMRLCDEEGIVVIDETTAVGVNLQFGGGANFGGERIGTFDKEHGVQTQEHHK DVIRDLISRDKNHACVVMWSIANEPDSAAEGAYDYFKPLYDLARELDPQKRPCTLVSC QGTTADTDCSSQLSDVICLNRYYGWYFGGPDLEVSEIGLRKELSDWGKLGKPVMFTE YGADTVSGLHDTTSVMYTEEYQVEYYEMNNKVFDEFDFVVGEQAWNFADFATSQSL LRVQGNKKGLFTRDRKPKMVAHYFRNRWSTIPEFGYKTK (EeV459C) |
| 75 | MLYPVLTQSRLLSDLSGVWDFKLDNGKGFEEKWYEKPLKDADTMPVPASYNDLKEG TDFRDHYGWVFYQRNISVPEYVKSQRIVLRCAAVTHYAMIYLNGKLICEHKGGFLPFE VELNDDLQDGDNLLTIAVNNVIDYTTLPVGGKANMMSGMMGGMGAGASDKPQNNP NFDFFNYCGITRPVKIYTTPETYINDITVTADIDFTKEEPSAVLNYNVEIKGKDYNNITC KVELFDEEGTKLSETEGSEGTFEISNVRLWQPLNAYLYKIKVTAGQDVYTLPYGVRSV RVDGTKFLINEKPFYFKGYGKHEDTFPNGRGINLPMNTKDISIMKWQHANSFRTSHY PYSEEMMRLCDEEGIVVIDETTAVGVNLQFGGGANFGGERIGTFDKEHGVQTQEHHK DVIRDLISRDKNHACVVMWSIANEPDSAAEGAYDYFKPLYDLARELDPQKRPCTLVS GQGTTADTDCSSQLSDVICLNRYYGWYFGGPDLEVSEIGLRKELSDWGKLGKPVMFT EYGADTVSGLHDTTSVMYTEEYQVEYYEMNNKVFDEFDFVVGEQAWNFADFATSQS LLRVQGNKKGLFTRDRKPKMVAHYFRNRWSTIPEFGYKTK (EeV459G) |
| 76 | MLYPVLTQSRLLSDLSGVWDFKLDNGKGFEEKWYEKPLKDADTMPVPASYNDLKEG TDFRDHYGWVFYQRNISVPEYVKSQRIVLRCAAVTHYAMIYLNGKLICEHKGGFLPFE VELNDDLQDGDNLLTIAVNNVIDYTTLPVGGKANMMSGMMGGMGAGASDKPQNNP NFDFFNYCGITRPVKIYTTPETYINDITVTADIDFTKEEPSAVLNYNVEIKGKDYNNITC KVELFDEEGTKLSETEGSEGTFEISNVRLWQPLNAYLYKIKVTAGQDVYTLPYGVRSV RVDGTKFLINEKPFYFKGYGKHEDTFPNGRGINLPMNTKDISIMKWQHANSFRTSHY PYSEEMMRLCDEEGIVVIDETTAVGVNLQFGGGANFGGERIGTFDKEHGVQTQEHHK DVIRDLISRDKNHACVVMWSIANEPDSAAEGAYDYFKPLYDLARELDPQKRPCTLVSE QGTTADTDCSSQLSDVICLNRYYGWYFGGPDLEVSEIGLRKELSDWGKLGKPVMFTE YGADTVSGLHDTTSVMYTEEYQVEYYEMNNKVFDEFDFVVGEQAWNFADFATSQSL LRVQGNKKGLFTRDRKPKMVAHYFRNRWSTIPEFGYKTK (EeV459E) |
| 77 | MVNSMLYPRESRTRRVVDISGMWEFKIDINNEGRNSGYANGLKDTTFIPVPSSFNDLF TDKNIREHAGDVWYETSFYLPLEWKDKDVNVRFGCATHEATVYINGKEVCTHVGGF MPFNAPVNEAGIFGEKNKLVVVVNNELSNTTIPCGHTETKPSGKKYIKPSFDFFNYAG LNRPVKITVTNKEYIHDIDILSDVNGSDGIVNYEVHTTGENKVYIKINDEEGKEVASCE GKSGKIVIKDAKLWNPKAAYLYKFIACIKNGDELIDEYYLDFGIRTVKVEGTKFLINGK PFYFTGFGKHEDSEIAGRGYNPPVIKRDFELIKWVGANSFRTSHYPYSEEIMQAADRE GIVIIDEVAAVGMFDVGSVLNPSASKTDYFSLDEVHSKTKEVHKKAVEELIKRDKNHP SVVMWSLFNEPDTSKDEAVPYFEDIFNFAKSQDKQNLPKTFAAIDASSPGKCKCMHL |

SUMMARY OF SEQUENCE LISTING

| SEQ ID NO: | DESCRIPTION |
|---|---|
| | CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451D) |
| 78 | MVNSMLYPRESRTRRVVDISGMWEFKIDINNEGRNSGYANGLKDTTFIPVPSSFNDLF<br>TDKNIREHAGDVWYETSFYLPLEWKDKDVNRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIEASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451E) |
| 79 | MVNSMLYPRESRTRRVVDISGMWEFKIDINNEGRNSGYANGLKDTTFIPVPSSFNDLF<br>TDKNIREHAGDVWYETSFYLPLEWKDKDVNRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIGASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451G) |
| 80 | MVNSMLYPRESRTRRVVDISGMWEFKIDINNEGRNSGYANGLKDTTFIPVPSSFNDLF<br>TDKNIREHAGDVWYETSFYLPLEWKDKDVNRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAISASSPGKCKCMHLC<br>DVITLNRYYGWYFLGGYEIDMSEEKFREEMNLYSNMNKPVMFTEYGADTYAGVHKL<br>PSVMWSEEYQCEYYEMNFKVFDSYDFIVGEQLWNFADFQTTEGIFRVDGNKKGIFTR<br>NRQPKAVAHLIRSRWNKLPLDYKSKK<br>(BpQ451S) |
| 81 | MVNSMLYPRESRTRRVVDISGMWEFKIDINNEGRNSGYANGLKDTTFIPVPSSFNDLF<br>TDKNIREHAGDVWYETSFYLPLEWKDKDVNRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIVASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451V) |
| 82 | MVNSMLYPRESRTRRVVDISGMWEFKIDINNEGRNSGYANGLKDTTFIPVPSSFNDLF<br>TDKNIREHAGDVWYETSFYLPLEWKDKDVNRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIKASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451K) |
| 83 | MVNSMLYPRESRTRRVVDISGMWEFKIDINNEGRNSGYANGLKDTTFIPVPSSFNDLF<br>TDKNIREHAGDVWYETSFYLPLEWKDKDVNRFGCATHEATVYINGKEVCTHVGGF<br>MPFNAPVNEAGIFGEKNKLVVVVNNELSNTTIPCGHTETKPSGKKYIKPSFDFFNYAG |

SUMMARY OF SEQUENCE LISTING

| SEQ ID NO: | DESCRIPTION |
|---|---|
| | LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQDSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpA452D) |
| 84 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQKSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpA452K) |
| 85 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQNSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpA452N) |
| 86 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQGSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpA452G) |
| 87 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQESSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpA452E) |
| 88 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE |

SUMMARY OF SEQUENCE LISTING

| SEQ ID NO: | DESCRIPTION |
|---|---|
| | GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQQSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpA452Q) |
| 89 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QATTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeG461A) |
| 90 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QHTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeG461H) |
| 91 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QNTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeG461N) |
| 92 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QSTTADTDCSSQLSDVICLNRYYGWYFGGPDLEVSEIGLRKELSDWGKLGKPVMFTEY<br>GADTVSGLHDTTSVMYTEEYQVEYYEMNNKVFDEFDFVVGEQAWNFADFATSQSLL<br>RVQGNKKGLFTRDRKPKMVAHYFRNRWSTIPEFGYKTK<br>(EeG461S) |
| 93 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEEIFRVDGNKKGIFT<br>RNRQPKAVAHLIRSRWNKLPLDYKSKK<br>(BpG563E) |

SUMMARY OF SEQUENCE LISTING

| SEQ ID NO: | DESCRIPTION |
|---|---|
| 94 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEAIFRVDGNKKGIFT<br>RNRQPKAVAHLIRSRWNKLPLDYKSKK<br>(BpG563A) |
| 95 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEDIFRVDGNKKGIFT<br>RNRQPKAVAHLIRSRWNKLPLDYKSKK<br>(BpG563D) |
| 96 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEYIFRVDGNKKGIFT<br>RNRQPKAVAHLIRSRWNKLPLDYKSKK<br>(BpG563Y) |
| 97 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQGL<br>LRVQGNKKGLFTRDRKPKMVAHYFRNRWSTIPEFGYKTK<br>(EeS571G) |
| 98 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQNL<br>LRVQGNKKGLFTRDRKPKMVAHYFRNRWSTIPEFGYKTK<br>(EeS571N) |
| 99 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMHDFQLMDWMGANSFRTSHYPYAEEVMEFAD<br>RHGIVVIDETPAVGLAFSIGSGVSSEDSPQTFTPEGINNNTREAHKQAIRELIARDKNH |

| SEQ ID NO: | DESCRIPTION |
|---|---|
| | ASVVMWSIANEPASQEVGAREYFAPLVDLAHELDPSRPVCFANYGDATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVVIIRVDGNKKGVFTR<br>ERKPKAAAHTLKTRWSGMLGSDH<br>(Rxn3G560V) |
| 100 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGDATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVEIIRVDGNKKGVFTR<br>ERKPKAAAHTLKTRWSGMLGSDH<br>(Rxn3G560E) |
| 101 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYCGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y/T295C) |
| 102 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYIGFGKHEDSEIAGRGYNPPVIKRDFELIKWVGANSFRTSHYPYSEEIMQAADREG<br>IVIIDEVAAVGMFDVGSVLNPSASKTDYFSLDEVHSKTKEVHKKAVEELIKRDKNHPS<br>VVMWSLFNEPDTSKDEAVPYFEDIFNFAKSQDKQNLPKTFAAIQASSPGKCKCMHLC<br>DVITLNRYYGWYFLGGYEIDMSEEKFREEMNLYSNMNKPVMFTEYGADTYAGVHKL<br>PSVMWSEEYQCEYYEMNFKVFDSYDFIVGEQLWNFADFQTTEGIFRVDGNKKGIFTR<br>NRQPKAVAHLIRSRWNKLPLDYKSKK<br>(BpF294Y/T295I) |
| 103 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYVGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y/T295V) |
| 104 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYFGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y/T295F) |
| 105 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF |

| SUMMARY OF SEQUENCE LISTING | |
|---|---|
| SEQ ID NO: | DESCRIPTION |
| | MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYMGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y/T295M) |
| 106 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYKGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y/T295K) |
| 107 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFVGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAALQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295V/I450L) |
| 108 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFVGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAMQASSPGKCKCMH<br>LCDVITLNRYYGWYFLGGYEIDMSEEKFREEMNLYSNMNKPVMFTEYGADTYAGVH<br>KLPSVMWSEEYQCEYYEMNFKVFDSYDFIVGEQLWNFADFQTTEGIFRVDGNKKGIF<br>TRNRQPKAVAHLIRSRWNKLPLDYKSKK<br>(BpT295V/I450M) |
| 109 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFVGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAYQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295V/I450Y) |
| 110 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFVGFGKHEDSEIAGRGYNPPVIKRDFELIKWVGANSFRTSHYPYSEEIMQAADRE |

| SEQ ID NO: | DESCRIPTION |
|---|---|
| | GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAVQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295V/I450V) |
| 111 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSPRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAMDASSPGKCKCMH<br>LCDVITLNRYYGWYFLGGYEIDMSEEKFREEMNLYSNMNKPVMFTEYGADTYAGVH<br>KLPSVMWSEEYQCEYYEMNFKVFDSYDFIVGEQLWNFADFQTTEGIFRVDGNKKGIF<br>TRNRQPKAVAHLIRSRWNKLPLDYKSKK<br>(BpI450M/Q451D) |
| 112 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSPRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAQDASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpI450Q/Q451D) |
| 113 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSPRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIDESSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451D/A452E) |
| 114 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSPRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIDGSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451D/A452G) |
| 115 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSPRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIDQSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451D/A452Q) |

| SUMMARY OF SEQUENCE LISTING |
|---|

| SEQ ID NO: | DESCRIPTION |
|---|---|
| 116 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIDSSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451D/A452S) |
| 117 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIDRSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451D/A452R) |
| 118 | MLYPVLTCSRLLSDLSGVWDFKLDNGKGFEEKWYEKPLKDADTMPVPASYNDLKEG<br>TDFRDHYGWVFYQRNICVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNCVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeQ8C/S73C) |
| 119 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRCPKMVAHYFRNRWSTIPEFGYKTK<br>(EeK588C) |
| 120 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGCDLEVSEIGLRKELSDWGKLGKPVMFTE<br>YGADTVSGLHDTTSVMYTEEYQVEYYEMNNKVFDEFDFVVGEQAWNFADFATSCSL<br>LRVQGNKKGLFTRDRKPKMVAHYFRNRWSTIPEFGYKTK<br>(EeP489C/Q570C) |

SEQUENCE LISTING (120 sequences)

SEQ ID NO: 1 - protein, 604 aa, Aspergillus oryzae
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKTFQ

SEQ ID NO: 2 - protein, 599 aa, Aspergillus terreus
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 3 - protein, 594 aa, Bacteroides fragilis
MKKLLAAAMLFMLNSWSCFSADTPRAEYPRPQFEREQWVNLNGTWTFDFDFGKSGKDRRLQSAEKFDKNITVPFCPESKLSGVGYTDFIEQMWYQRNITIPSDWNGKKIFLNFGAVDYCAEIYVDGKFVQRHFGGSSSFAVDLTRYVTPGKTHNLVVFVQDDLRSGLQTGGKQCGNYYSGGCSYTRTTGIWQTVWMEAVSADGLKSVFVRPDIDQKQLVIEPEFYNESANTLEITLKDRNKTVAKKSVNCANSSVVVLPVKNMKLWSPEDPFLYDLVYQVKDAKGNVLDEVKSYAGMRKVHTANGRFYLNNQPYFQRLVLDQGFYPEGIWTAPSDEDLKNDIVLGKEAGFNGARLHQKVFEERYYYWADKLGYITWGESASWMLDVNKELAARNFLGEWSEVVVRDRNHPSLVTWTPFNETWGGGPDAYIRLVRDVYNITKAIDPTRPVNDASGDNHVITDIWSVHNYEQDRAKLTEQLKMEEGKEPYRNARDKDFLAVYEGQPYMVDEFGGIPWMAEKDRKNSWGYGGMPENAEAFYKRLEGQIDAFIDSPHVTGFCYTQLTDVEQEKNGIYYYDRTPKLDMKRIKAIFEKIK

SEQ ID NO: 4 - protein, 603 aa, Bacteroides uniformis
MKTLLKNSLTFLLMLMPVLAFAQQAPQIMNVSARQTTSLDGQWKTIVDPFENGYYDYRLKPYDGGYAQDKTYSDKTKLQEYDFETDKLLFVPGDWNTQRPQLYYYEGTVWYRKHFEYSLQPGKRLFLNFGAVNYEAIVWLNGKRLGRHIGGFTPFNFEITNLLKEGTNSLVVKVDNKRLPEAVPTVNADWWNFGGITRPVTLIEMPATYIRDYYVQLAKDDKNMIEGWVQLEGSDKEQKITLDIPELKVKKEVTTDANGYASFLIKSKPILWTPENPKLYAVNLASETDKVSDEIGFRTIRTEGIKILLNDKEIFCRGISIHEETPYYSGRAYSKDHAHTLLSWAKELGCNFVRLAHYPHNEEMVREAERMGFLVWSEIPVYWTIHWENKDTYQNAEQQLCDMIARDKNRCNIIIWSIANETPHSETRLTFLSNLANKARSLDSVRLIGAAMEKEEVQPGVLTVNDPLGELLDIISFNEYVGWYDGDSEKCDRVNWTFDTQKPVFISELGGGALYGRHGSPKERFTEEYQEDLYIRHVNMLKRIPGLAGTTPWILKDFRSPRRHVPEIQDDFNRKGLVSDKGQKKKAFFVLQKWYKELTEAYK

SEQ ID NO: 5 - protein, 603 aa, Brachyspira pilosicoli
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 6 - protein, 601 aa, Brachyspira murdochii
MVNSMLYPRESRTRRVVDISGMWEFKIDSNNEGRKNGYANGLKDTTFIPVPSSFNDLFTDKNIREHAGDIWYETSFYLPLEWKDKNVNIRFGCATHEAAVYINGKEVCTHVGGFMPFNAPVNEAGIFGEKNKLVVVVNNELSNTTLPCGHTETKPSGKKYIKPSFDFFNYAGLNRPVKITVTNKEYIYDIDILSDINGSDGIVNYEVHTTGENKVFVKIYDEEGKEAASAEGKNGKIVIKNAKLWNPKAAYLYKFEACIKNGEELIDEYYLDFGIRTIKVEGTKFLINGKPFYFTGFGKHEDSETAGRGYNPPVIKRDFELIKWIGANSFRTSHYPYSEEIMQAADREGIVIIDEIAAVGMFDVGSVLNPGASKADYFSLEEVHTKTKEIHKKAVEELITRDKNHPSVVMWSLFNEPDTSKDEALPYFEDIFNFAKSIDKQNLPKTFAAIQASAPGKCKCMHLCDVITLNRYYGWYFLGGYEIDMSEEKFREEMNLYKDMNKPVMFTEYGADTYAGVHKLPSVMWSEEYQCEYYEMNFKVFDSYDFIIGEQLWNFADFQTTEGIFRVDGNKKGIFTRTRQPKAVAHYIRSRWTKLPLDYKK

SEQ ID NO: 7 - protein, 599 aa, Clostridium perfringens
MLYPIITESRQLIDLSGIWKFKLNEGNGLTEELSKAPLEDTIEMAVPSSYNDLVESQEVRDHVGWVWYERNFTIPKTLLNERIVLRFGSATHEAKVYLNGELLVEHKGGFTPFEAEINDLLVSGDNRLTVAVNNIIDETTLPVGLVKEVEVDGKKVIKNSVNFDFFNYAGIHRPVKIYTTPKSYIEDITIVTDFKENNGYVNYEVQAVGKCNIKVTIIDEENNIVAEGEGKEGKLTINNVHLWEPMNAYLYKLKVELLDDEEIIDTYFEEFGVRTVEVKDGKFLINNKPFYFKGFGKHEDSYVNGRGINEAINIKDFNLMKWIGANSFRTSHYPYSEEIMRLADREGIVVIDETPAVGLHLNFMATGFGGDAPKRDTWKEIGTKEAHERILRELVSRDKNHPCVVMWSVANEPDSDSEGAKEYFEPLIKLTKELDPQKRPVTVVTYLMSTPDRCKVGDIVDVLCLNRYYGWYVAGGDLEEAKRMLEDELKGWEERCPKTPIMFTEYGADTVAGLHDTVPVMFTEEYQVEYYKANHEVMDKCKNFVGEQVWNFADFATSQGIIRVQGNKKGIFTRERKPKMIAHSLRERWTNIPEFGYKK

SEQ ID NO: 8 - protein, 603 aa, Escherichia coli
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 9 - protein, 608 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKQGLCGR

SEQ ID NO: 10 - protein, 611 aa, Eubacterium eligens
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 11 - protein, 651 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 12 - protein, 603 aa, Lactobacillus brevis
MLYPMETASRVVLDLSGVWRFMIDKEQIPVDVTRPLPATLSMAVPASFNDQTASKEIREHVGYVWYERCFELPQLLRQERLVLRFGSATHEAWVYLNGHLITHHKGGFTPFEVEINDDLVTGENRLTVKLSNMLDYTTLPVGHYKETQNETGQRVRQLDENFDFFNYAGLQRPVKIYSTPHSYIRDITLTPKVNLTNHSAVVNGEIETVGDVEQVVVTILDEDNQVVGTTSGKTLAIELNSVHLWQPGKAYLYRAKVELYQAGQVIDTYIETFGIRQIAVKAGKFLINGQPFYFKGFGKHEDAYIHGRGLSEPQNVLDLSLMKQMGANSFRTSHYPYSEEMMRLCDREGIVVIDEVPAVGLMLSFTFDVSALEKDDFEDDTWEKLRTAEAHRQAITEMIDRDKNHASVVMWSISNEAANFSKGAYEYFKPLFDLARKLDPQQRPCTYTSIMMTTLKTDRCLALADVIALNRYYGWYMGNGDLKAAETATREELLAYQAKFPDKPIMYTEYGADTIAGLHSNYDEPFSEEFQEDYYRMCSRVFDEVTNFVGEQLWNFADFQTKFGIQRVQGNKKGIFTRAREPKMVVRYLTQRWRNIPDFNYKK

SEQ ID NO: 13 - protein, 648 aa, Mus musculus
MSLKWSACWVALGQLLCSCALALKGGMLFPKESPSRELKALDGLWHFRADLSNNRLQGFEQQWYRQPLRESGPVLDMPVPSSFNDITQEAALRDFIGWVWYEREAILPRRWTQDTDMRVVLRINSAHYYAVVWVNGIHVVEHEGGHLPFEADISKLVQSGPLTTCRITIAINNTLTPHTLPPGTIVYKTDTSMYPKGYFVQDTSFDFFNYAGLHRSVVLYTTPTTYIDDITVITNVEQDIGLVTYWISVQGSEHFQLEVQLLDEGGKVVAHGTGNQGQLQVPSANLWWPYLMHEHPAYMYSLEVKVTTTESVTDYYTLPIGIRTVAVTKSKFLINGKPFYFQGVNKHEDSDIRGKGFDWPLLVKDFNLLRWLGANSFRTSHYPYSEEVLQLCDRYGIVVIDECPGVGIVLPQSFGNESLRHHLEVMEELVRRDKNHPAVVMWSVANEPSSALKPAAYYFKTLITHTKALDLTRPVTFVSNAKYDADLGAPYVDVICVNSYFSWYHDYGHLEVIQPQLNSQFENWYKTHQKPIIQSEYGADAIPGIHEDPPRMFSEEYQKAVLENYHSVLDQKRKEYVVGELIWNFADFMTNQSPLRVIGNKKGIFTRQRQPKTSAFILRERYWRIANETGGHGSGPRTQCFGSRPFTF

SEQ ID NO: 14 - protein, 617 aa, Parabacteroides sp.
MKRISIAFLSLFLCVASVWSMPRPEYPRPQFERAGWVNLNGEWTCSFDFGGSGMEREFYKSKGFDKKITVPFCPESKLSGIGYTDFINHFWYQRPITIPQEWNGKNILLNFGAVYYKSEVYIDGVLASRHFGGTSSFAVDITSLVKPGQTHSLVVYVESDVRGAKQAAGKQNLQYASYGCNYTRTTGIWQTVWMEAVHPEGLQSIQLLTDIDQQQLVVRPRFYKEAGGKLQVTLKDNGKVVASRTVSASSLSSVVLPVKKMKTWSPESPFLYDLEYKVLDKNGNIIDEVNGYAGMRKVHIEGNKIYLNNKPYYQRLVLDQGFYPDGIWTAPSDEALKRDIELSMEAGFNGARLHQKVFEERFYYWADKMGYLTWGEASSWGMDCNDTETARNFITEWSEIVQRDRNHPSLLIWTPTNEEFWPDRVQYPRLMHDLYNLTKMIDPTRPFHGASGGTHIATDIWTVHNYEQDPAKLKEKLYNGGKLMEAPKWEIHLMPMNIGYNGLKYTDQYAFPEYKKDMPYLVDEFGGIKWNPSQQMESAQNTSWGYGEPPRSLEEFYARLEGQVDAVLSLSNDIWGYCYTQLTDVEQEQNGIYYYDRTPKFDMKRIHAIFSKTPESK

SEQ ID NO: 15 - protein, 602 aa, Staphylococcus sp.
MLYPINTETRGVFDLNGVWNFKLDYGKGLEEKWYESKLTDTISMAVPSSYNDIGVTKEIRNHIGYVWYEREFTVPAYLKDQRIVLRFGSATHKAIVYVNGELVVEHKGGFLPFEAEINNSLRDGMNRVTVAVDNILDDSTLPVGLYSERHEEGLGKVIRNKPNFDFFNYAGLHRPVKIYTTPFTYVEDISVVTDFNGPTGTVTYTVDFQGKAETVKVSVVDEEGKVVASTEGLSGNVEIPNVILWEPLNTYLYQIKVELVNDGLTIDVYEEPFGVRTVEVNDGKFLINNKPFYFKGFGKHEDTPINGRGFNEASNVMDFNILKWIGANSFRTAHYPYSEELMRLADREGLVVIDETPAVGVHLNFMATTGLGEGSERVSTWEKIRTFEHHQDVLRELVSRDKNHPSVVMWSIANEAATEEEGAYEYFKPLVELTKELDPQKRPVTIVLFVMATPETDKVAELIDVIALNRYNGWYFDGGDLEAAKVHLRQEFHAWNKRCPGKPIMITEYGADTVAGFHDIDPVMFTEEYQVEYYQANHVVFDEFENFVGEQAWNFADFATSQGVMRVQGNKKGVFTRDRKPKLAAHVFRERWTNIPDFGYKN

SEQ ID NO: 16 - protein, 599 aa, Streptococcus agalactiae
MLYPLLTKTRNTYDLGGIWNFKLGEHNPNELLPSDEVMVIPTSFNDLMVSKEKRDYIGDFWYEKVIEVPKVSEGEEMVLRFGSVTHQAKIYVDGILVGEHKGGFTPFEVLVPECKYNNEKIKVSICANNVLDYTTLPVGNYSEIIQEDGSIKKKVRENFDFFNYAGVHRPLKLMIRPKNHISDITITSRLSDDLQSADLHFLVETNQKVDEVRISVFDEDNKLVGETKDSRLFLSDVHLWEVLNAYLYTARVEIFVDNQLQDVYEENFGLREIEVTNGQFLLNRKPIYFKGFGKHEDTFINGRGLNEAANLMDLNLLKDIGANSFRTSHYPYSEEMMRLADRMGVLVIDEVPAVGLFQNFNASLDLSPKDNGTWSLMQTKAAHEQAIQELVKRDKNHPSVVMWVVANEPASHEAGAHDYFEPLVKLYKDLDPQKRPVTLVNILMATPDRDQVMDLVDVVCLNRYYGWYVDHGDLTNAEVGLRKELLEWQDKFPDKPIIITEYGADTLPGLHSTWNIPYTEEFQCDFYEMSHRVFDGIPNLVGEQVWNFADFETNLMILRVQGNHKGLFSRNRQPKQVVKEFKKRWMTIPHYHNKKNSVK

SEQ ID NO: 17 - protein, 606 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKTFQ

SEQ ID NO: 18 - protein, 609 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKTFQ

SEQ ID NO: 19 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 20 - protein, 607 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSDH

SEQ ID NO: 21 - protein, 612 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKQGLCGR

SEQ ID NO: 22 - protein, 612 aa, Artificial Sequence; identical to SEQ ID NO: 21
  Description of Artificial Sequence: Synthetic polypeptide

SEQ ID NO: 23 - protein, 605 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKQGLCGR

SEQ ID NO: 24 - protein, 600 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSKQGLCGR

SEQ ID NO: 25 - protein, 606 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKTFQ

SEQ ID NO: 26 - protein, 596 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 27 - protein, 606 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGRHEDADLRGKGFDNVLMVHDHALMDWIGANSYRTSHYPYAEEMLDWADEHGIVVIDETPAVGLAFSIGSGVSSEDSPQTFTPEGINNNTREAHKQAIRELIARDKNHASVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSDH

SEQ ID NO: 28 - protein, 611 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGRHEDADLRGKGFDNVLMVHDHALMDWIGANSYRTSHYPYAEEMLDWADEHGIVVIDETPAVGLAFSIGAGAQTSNPPATFSPDRINNKTREAHAQAIRELIHRDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKQGLCGR

SEQ ID NO: 29 - protein, 606 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKQGLCGR

SEQ ID NO: 30 - protein, 601 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGKHEDSAVRGKGYDPAYMVHDFQLMDWMGANSFRTSHYPYAEEVMEFADRHGIVVIDETAAVGFNLSLGIGFEAGNKPKELYSEEAVNGETQQAHLQAIKELIARDKNHPSVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSKQGLCGR

SEQ ID NO: 31 - protein, 604 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDTNIRGKGHDDAYMVHDFQLLHWMGANSFRTSHYPYAEEVMEYADRQGIVVIDETPAVGLAFSIGSGVSSEDSPQTFTPEGINNNTREAHKQAIRELIARDKNHASVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKTFQ

SEQ ID NO: 32 - protein, 605 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKTFQ

SEQ ID NO: 33 - protein, 599 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 34 - protein, 600 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDSAVRGKGYDPAYMVHDFQLMDWMGANSFRTSHYPYAEEVMEFADRHGIVVIDETAAVGFNLSLGIGFEAGNKPKELYSEEAVNGETQQAHLQAIKELIARDKNHPSVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 35 - protein, 607 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKQGLCGR

SEQ ID NO: 36 - protein, 607 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETPAVGLAFSIGSGVSSEDSPQTFTPEGINNNTREAHKQAIRELIARDKNHASVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKQGLCGR

SEQ ID NO: 37 - protein, 614 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGGKANMMSGMMGGMGAGASDKPQNNPNFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 38 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDQFGGGANFGGERIGTFDKEHGSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 39 - protein, 614 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGGKANMMSGMMGGMGAGASDKPQNNPNFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDQFGGGANFGGERIGTFDKEHGSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 40 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGGGGANFGGERDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 41 - protein, 614 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGGKANMMSGMMGGMGAGASDKPQNNPNFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGGGGANFGGERDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 42 - protein, 602 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGCGHTETKPSGKKYIKPSFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 43 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLVGSVLNPSASKTDYFSLDEVHVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 44 - protein, 602 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGCGHTETKPSGKKYIKPSFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLVGSVLNPSASKTDYFSLDEVHVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 45 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFSVLNPSASKTIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 46 - protein, 602 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGCGHTETKPSGKKYIKPSFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFSVLNPSASKTIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 47 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYATGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 48 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYITGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 49 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYVTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 50 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 51 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYLTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 52 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYWTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 53 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYWKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 54 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYSKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 55 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFAGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 56 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFCGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 57 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFFGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 58 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFIGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 59 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFKGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 60 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFSGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 61 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 62 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFAGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 63 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFVGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 64 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAFQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 65 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAKQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 66 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAALQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 67 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAMQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 68 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAQQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 69 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAADQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 70 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAVQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 71 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSFQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 72 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSLQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 73 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSWQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 74 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSCQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 75 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSGQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 76 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSEQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 77 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 78 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIEASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 79 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIGASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 80 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAISASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 81 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIVASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 82 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIKASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 83 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQDSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 84 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQKSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 85 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQNSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 86 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQGSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 87 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQESSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 88 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQQSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 89 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQATTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 90 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQHTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 91 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQNTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 92 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQSTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 93 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEEIFRVDGNKKGIFTRNRQPKAVAHLIRSRWNKLPLDYKSKK

SEQ ID NO: 94 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEAIFRVDGNKKGIFTRNRQPKAVAHLIRSRWNKLPLDYKSKK

SEQ ID NO: 95 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEDIFRVDGNKKGIFTRNRQPKAVAHLIRSRWNKLPLDYKSKK

SEQ ID NO: 96 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEYIFRVDGNKKGIFTRNRQPKAVAHLIRSRWNKLPLDYKSKK

SEQ ID NO: 97 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQGLLRVQGNKKGLFTRDRKPKMVAHYFRNRWSTIPEFGYKTK

SEQ ID NO: 98 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQNLLRVQGNKKGLFTRDRKPKMVAHYFRNRWSTIPEFGYKTK

SEQ ID NO: 99 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVVIIRVDGNKKGVFTRERKPKAAAHTLKTRWSGMLGSDH

SEQ ID NO: 100 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVEIIRVDGNKKGVFTRERKPKAAAHTLKTRWSGMLGSDH

SEQ ID NO: 101 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYCGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 102 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYIGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 103 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 104 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYFGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 105 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYMGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 106 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYKGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 107 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAALQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 108 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAMQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 109 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAYQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 110 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAVQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 111 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAMDASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 112 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAQDASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 113 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDESSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 114 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDGSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 115 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDQSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 116 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDSSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 117 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDRSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 118 - protein, 611 aa, Artificial Sequence
  Description of Artificial Sequence: Synthetic polypeptide
MLYPVLTCSRLLSDLSGVWDFKLDNGKGFEEKWYEKPLKDADTMPVPASYNDLKEGTDFRDHYGWVFYQRNICVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 119 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRCPKMVAHYFRNRWSTIPEFGYKTK

SEQ ID NO: 120 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGCDLEVSEIGLRKELSDWGKLGKPVMFTEYGADTVSGLHDTTSVMYTEEYQVEYYEMNNKVFDEFDFVVGEQAWNFADFATSCSLLRVQGNKKGLFTRDRKPKMVAHYFRNRWSTIPEFGYKTK

What is claimed is:

1. A composition comprising a blend of *Brachyspira pilosicoli* beta-glucuronidase (BpGUS) and *Eubacterium eligens* beta-glucuronidase (EeGUS), wherein:
   (a) the blend comprises about 10%-30% BpGUS and about 70%-90% EeGUS; or
   (b) the blend comprises about 15%-25% BpGUS and about 75%-85% EeGUS; or
   (c) the blend comprises 15% BpGUS and 85% EeGUS; or
   (d) the blend comprises 25% BpGUS and 75% EeGUS; and
   wherein BpGUS comprises the amino acid sequence shown in SEQ ID NO: 5 and EeGUS comprises the amino acid sequence shown in SEQ ID NO: 10.

2. A formulation comprising the composition of claim 1, wherein the formulation comprises the enzyme blend and at least one excipient, wherein each enzyme in the blend is present at a concentration of at least 0.1 mg/mL.

3. The formulation of claim 2, wherein:
   (a) the formulation is an aqueous formulation;
   (b) the formulation is a lyophilized formulation;
   (c) the at least one excipient is selected from the group consisting of water, salts, buffers, sugars and amino acids; and/or
   (d) the formulation is free of polymers and detergents.

4. A packaged formulation comprising the formulation of claim 2 and a container.

5. The composition of claim 1, wherein the blend comprises about 10%-30% BpGUS and about 70%-90% EeGUS.

6. The composition of claim 1, wherein the blend comprises about 15%-25% BpGUS and about 75%-85% EeGUS.

7. The composition of claim 1, wherein the blend comprises 15% BpGUS and 85% EeGUS.

8. The composition of claim 1, wherein the blend comprises 25% BpGUS and 75% EeGUS.

* * * * *